(12) United States Patent
Nussenzweig et al.

(10) Patent No.: US 11,634,477 B2
(45) Date of Patent: Apr. 25, 2023

(54) NEUTRALIZING ANTI-SARS-COV-2 ANTIBODIES AND METHODS OF USE THEREOF

(71) Applicant: The Rockefeller University, New York, NY (US)

(72) Inventors: Michel Nussenzweig, New York, NY (US); Davide F. Robbiani, New York, NY (US)

(73) Assignee: The Rockefeller University, New York, NY (US)

(*) Notice: Subject to any disclaimer, the term of this patent is extended or adjusted under 35 U.S.C. 154(b) by 0 days.

(21) Appl. No.: 17/242,583

(22) Filed: Apr. 28, 2021

(65) Prior Publication Data

US 2021/0332110 A1 Oct. 28, 2021

Related U.S. Application Data

(60) Provisional application No. 63/119,088, filed on Nov. 30, 2020, provisional application No. 63/038,384, filed on Jun. 12, 2020, provisional application No. 63/032,112, filed on May 29, 2020, provisional application No. 63/021,387, filed on May 7, 2020, provisional application No. 63/016,569, filed on Apr. 28, 2020.

(51) Int. Cl.

| *C07K 16/00* | (2006.01) |
| *C12P 21/08* | (2006.01) |
| *A61K 39/395* | (2006.01) |
| *C07K 16/10* | (2006.01) |
| *A61K 45/06* | (2006.01) |
| *G01N 33/569* | (2006.01) |
| *C07K 1/00* | (2006.01) |

(52) U.S. Cl.
CPC ............ *C07K 16/10* (2013.01); *A61K 45/06* (2013.01); *G01N 33/56983* (2013.01); *C07K 2317/31* (2013.01); *C07K 2317/33* (2013.01); *C07K 2317/35* (2013.01); *C07K 2317/565* (2013.01); *C07K 2317/76* (2013.01); *G01N 2333/165* (2013.01)

(58) Field of Classification Search
None
See application file for complete search history.

(56) References Cited

U.S. PATENT DOCUMENTS

| 8,546,543 B2 * | 10/2013 | Lazar | ............. A61P 35/02 |
| | | | 530/387.1 |
| 9,676,863 B2 | 6/2017 | Lo | |
| 10,407,502 B2 | 9/2019 | Waksal et al. | |
| 11,053,304 B1 * | 7/2021 | Glanville | ............. A61P 31/14 |
| 2006/0121580 A1 * | 6/2006 | Ter Meulen | ............ C12N 7/00 |
| | | | 435/91.1 |

OTHER PUBLICATIONS

Janeway et al., Immunology Third Edition, Garland Publishing Inc. 1997, Chapters, Structure of the Antibody Molecule and Immunoglobulin Genes, pp. 3:1-3:11. (Year: 1997).*
Rudikoff et al., PNAS. 1982 vol. 79 p. 1979-83. (Year: 1982).*
Edwards et al. J. Mol. Biol. 2003, 334:103-118. (Year: 2003).*
Lloyd et al. Protein Engineering Design & Selection. 2009, 22;3:159-168. (Year: 2009).*
Goel et al. The Journal of Immunology. 2004, 173:7358-7367. (Year: 2004).*
Kanyavuz et al. Nature Review Immunology. 2019, 19:355-368. (Year: 2019).*
Tian et al. Emerging Microbes & Infections. Published online Feb. 17, 2020, 9:382-385. (Year: 2020).*
Robbiani et al. "Convergent antibody responses to SARS-CoV-2 in convalescent individuals", Nature, vol. 584, Aug. 20, 2020, published online Jun. 18, 2020, pp. 437-442, https://doi.org/10.1038/s41586-020-2456-9, 23 pages.
Barnes et al. "SARS-CoV-2 neutralizing antibody structures inform therapeutic strategies", Nature. Dec. 2020; 588(7839): 682-687. doi:10.1038/s41586-020-2852-1, 36 pages.
Chen et al., "Human monoclonal antibodies block the binding of SARS-Co V-2 spike protein to angiotensin converting enzyme 2 receptor", Cellular & Molecular Immunology, Chinese Society of Immunology, CH, vol. 17, No. 6, Apr. 20, 2020 (Apr. 20, 2020), pp. 647-649.
Wang et al., "A human monoclonal antibody blocking SARS-CoV-2 infection", bioRxiv, Mar. 12, 2020 (Mar. 12, 2020), 24 pages.
Pinto et al., "Structural and functional analysis of a potent sarbecovirus neutralizing antibody", bioRxiv, Apr. 10, 2020 (Apr. 10, 2020), 28 pages.
Ju et al., "Potent human neutralizing antibodies elicited by SARS-CoV-2 infection", Mar. 26, 2020 (Mar. 26, 2020), 42 pages.
Barnes et al, "Structions of Human Antibodies Bound to SARS-CoV-2 Spike Reveal Common Epitopes and Recurrent Features of Antibodies", Cell, vol. 182, No. 4, Aug. 20, 2020 (Aug. 20, 2020), pp. 828-842.
Partial International Search Report dated Oct. 5, 2021 in related International Application No. PCT/US2021/070472, 16 pages.

* cited by examiner

Primary Examiner — Chun W Dahle
(74) Attorney, Agent, or Firm — Fox Rothschild LLP

(57) ABSTRACT

This disclosure provides novel broadly neutralizing anti-SARS-CoV-2 antibodies or antigen-binding fragments thereof. The disclosed anti-SARS-CoV-2 antibodies constitute a novel therapeutic strategy in protection from SARS-CoV-2 infections.

12 Claims, 34 Drawing Sheets

Specification includes a Sequence Listing.

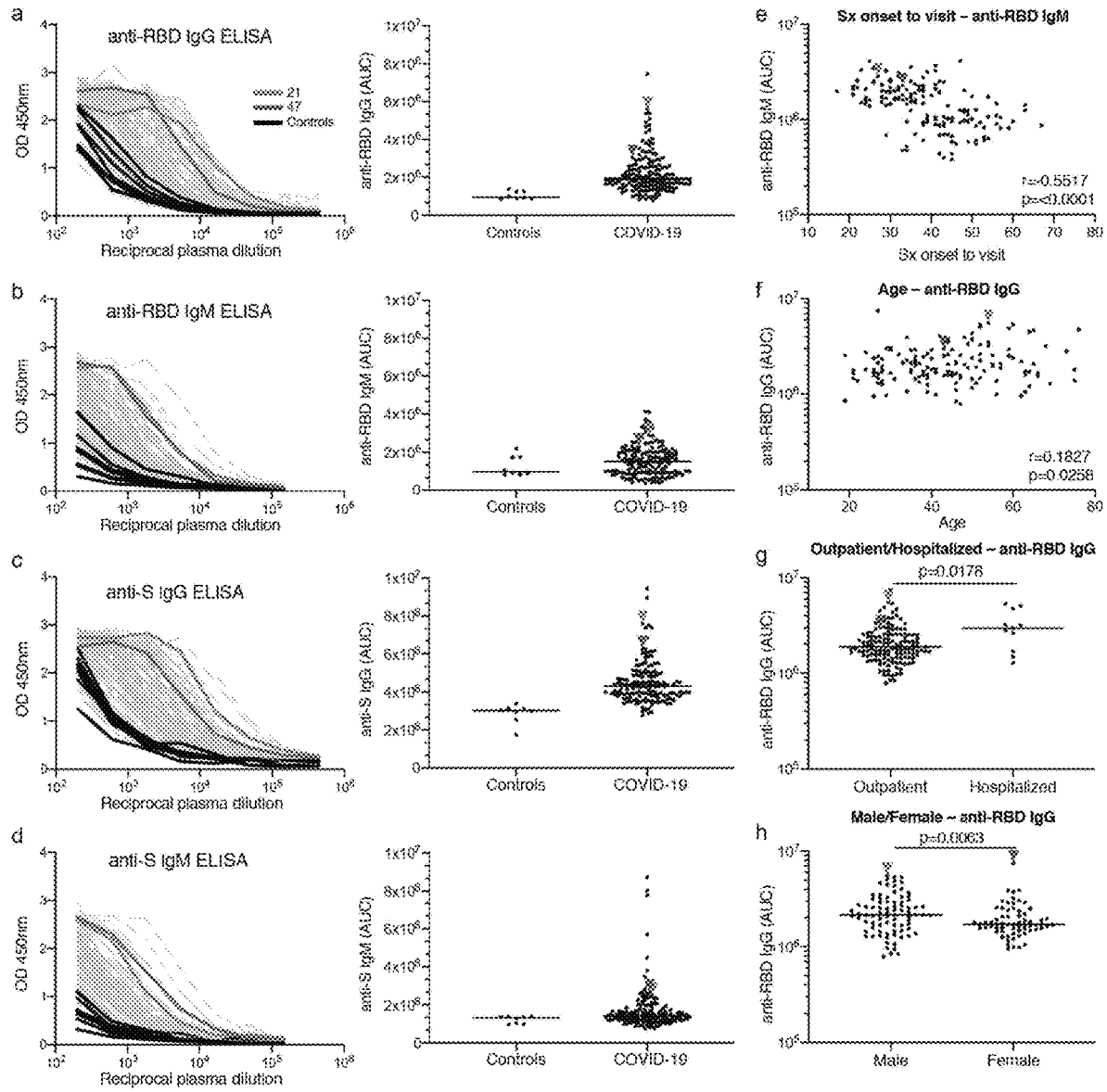
FIGS. 3A, 3B, 3C, 3D, 3E, 3F, 3G, and 3H

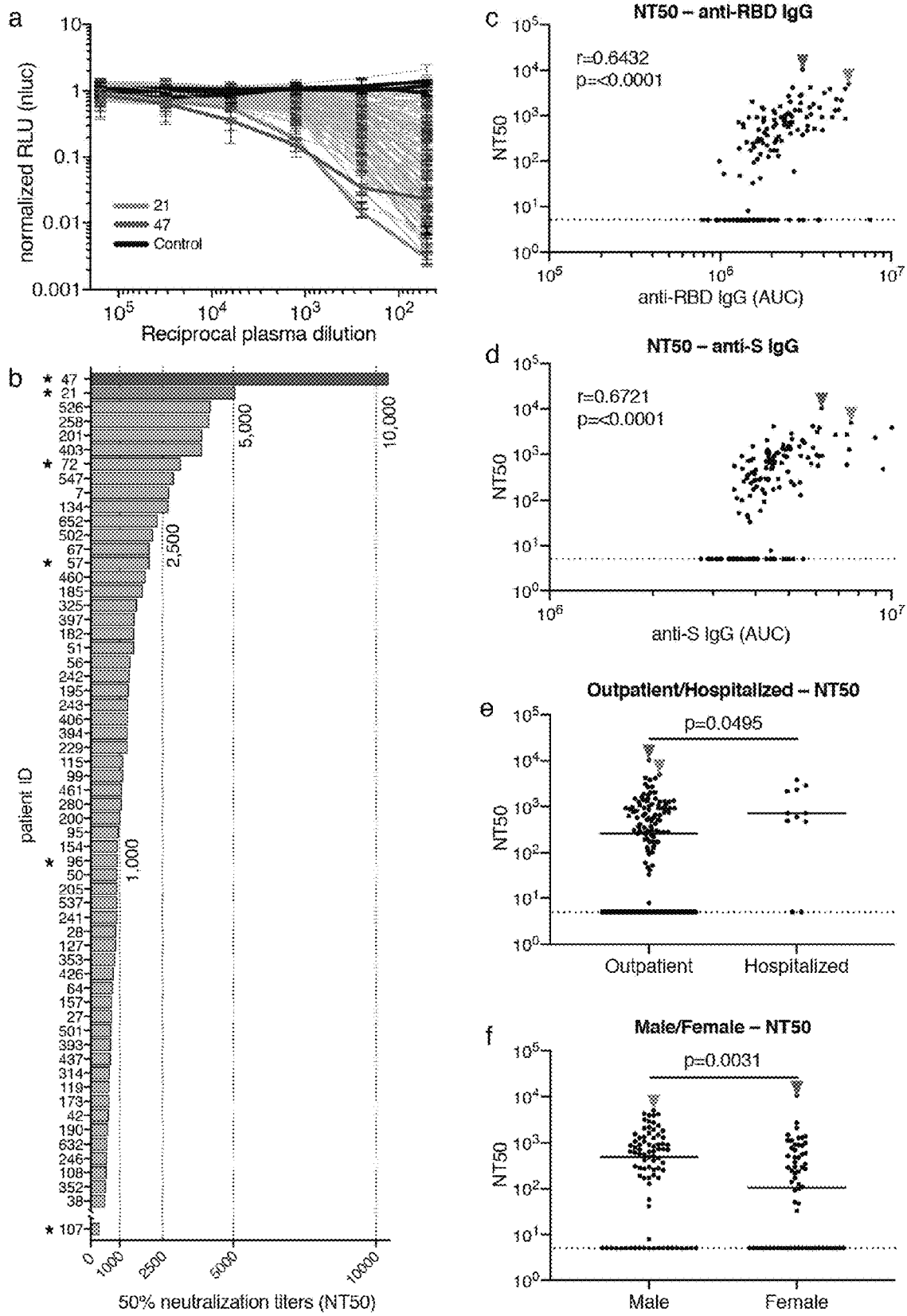
FIGS. 4A, 4B, 4C, 4D, 4E, and 4F

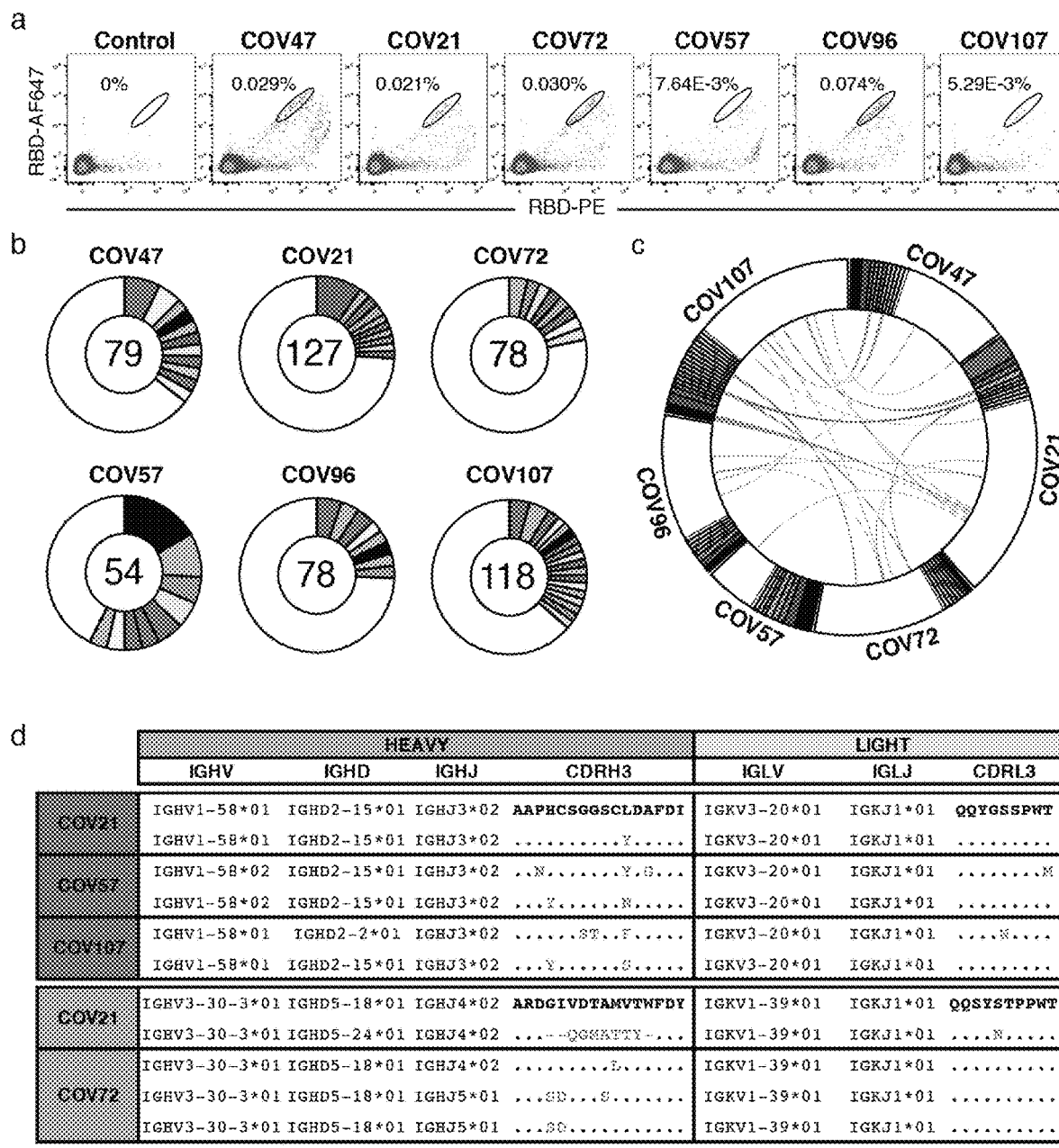
FIGS. 5A, 5B, 5C, and 5D

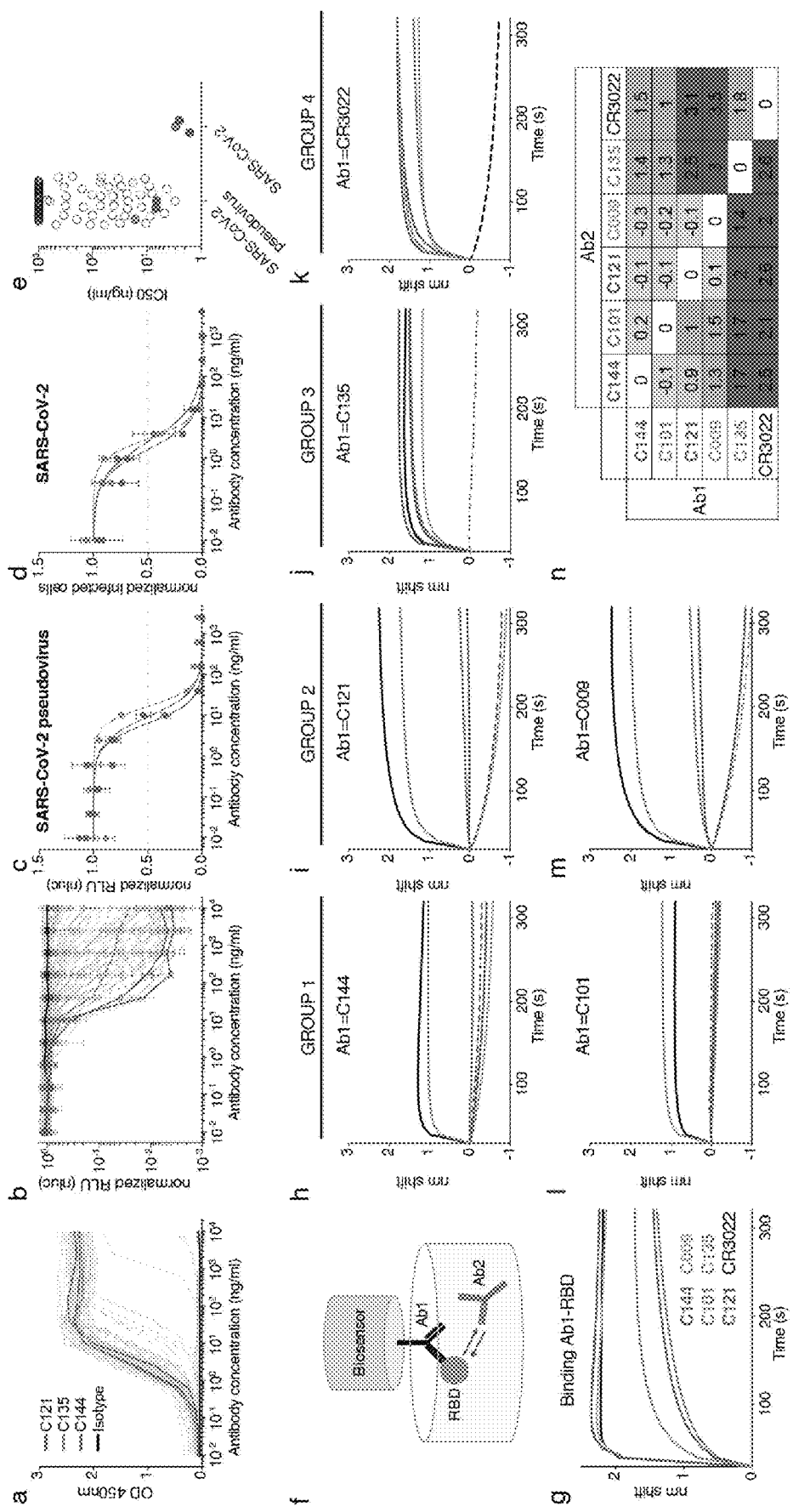
FIGS. 6A, 6B, 6C, 6D, 6E, 6F, 6G, 6H, 6I, 6J, 6K, 6L, 6M, and 6N

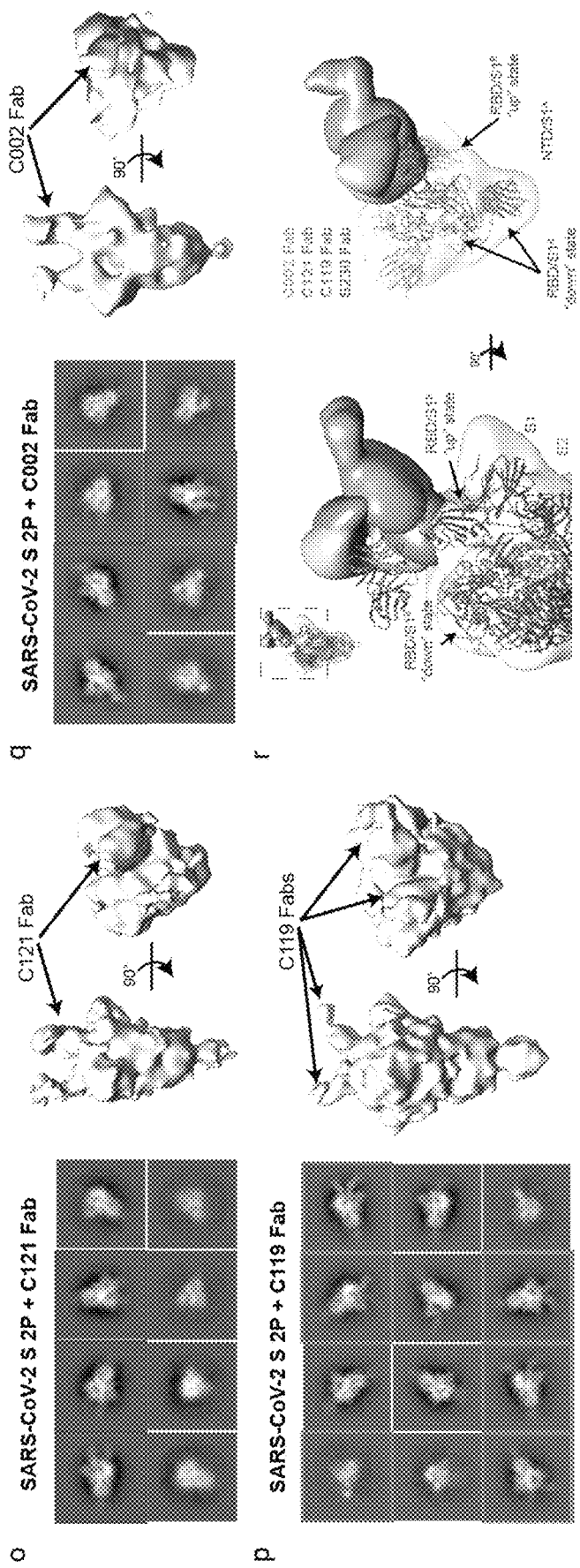
FIGS. 6O, 6P, 6Q, and 6R

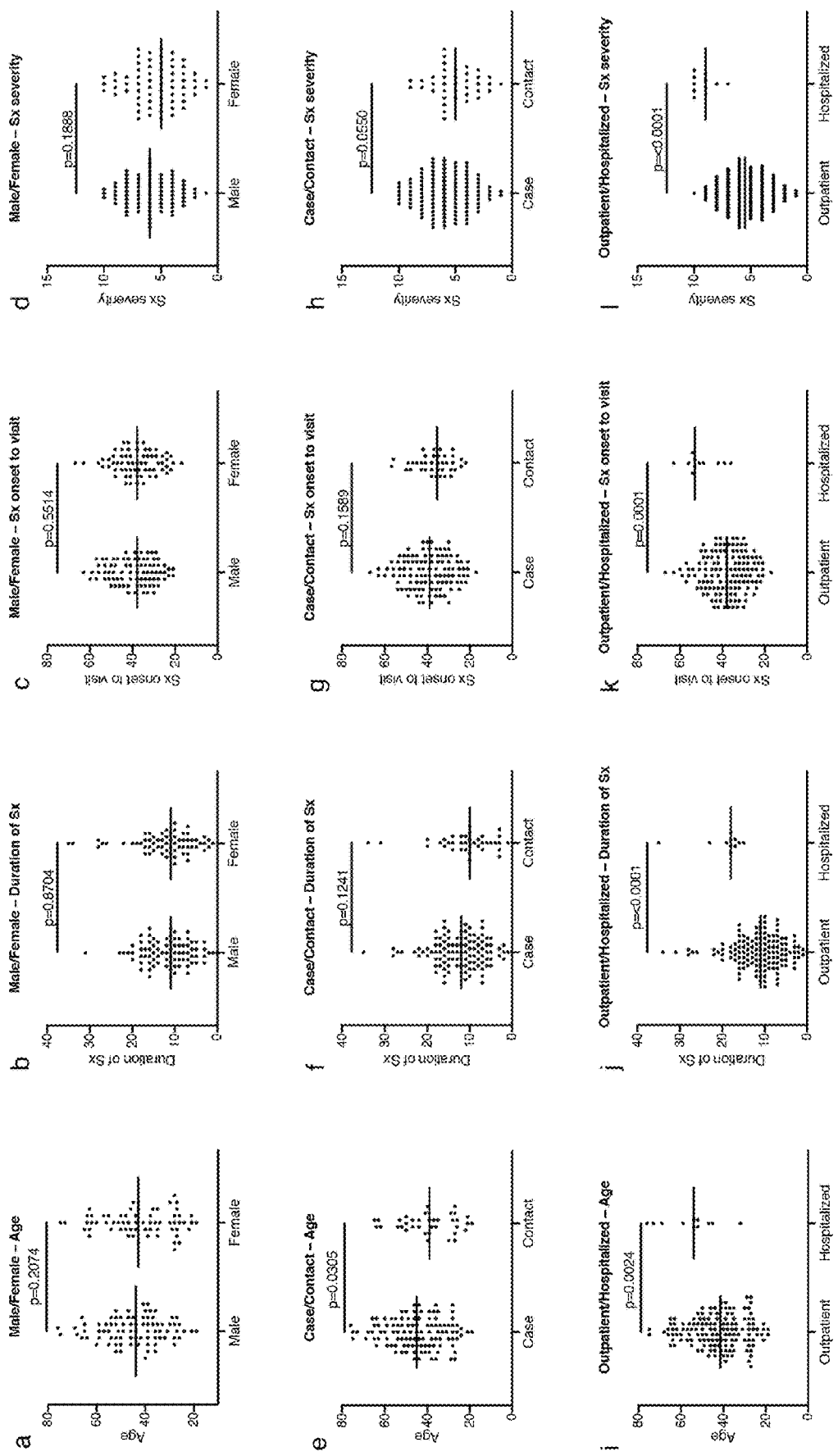
FIGS. 7A, 7B, 7C, 7D, 7E, 7F, 7G, 7H, 7I, 7J, 7K, and 7L

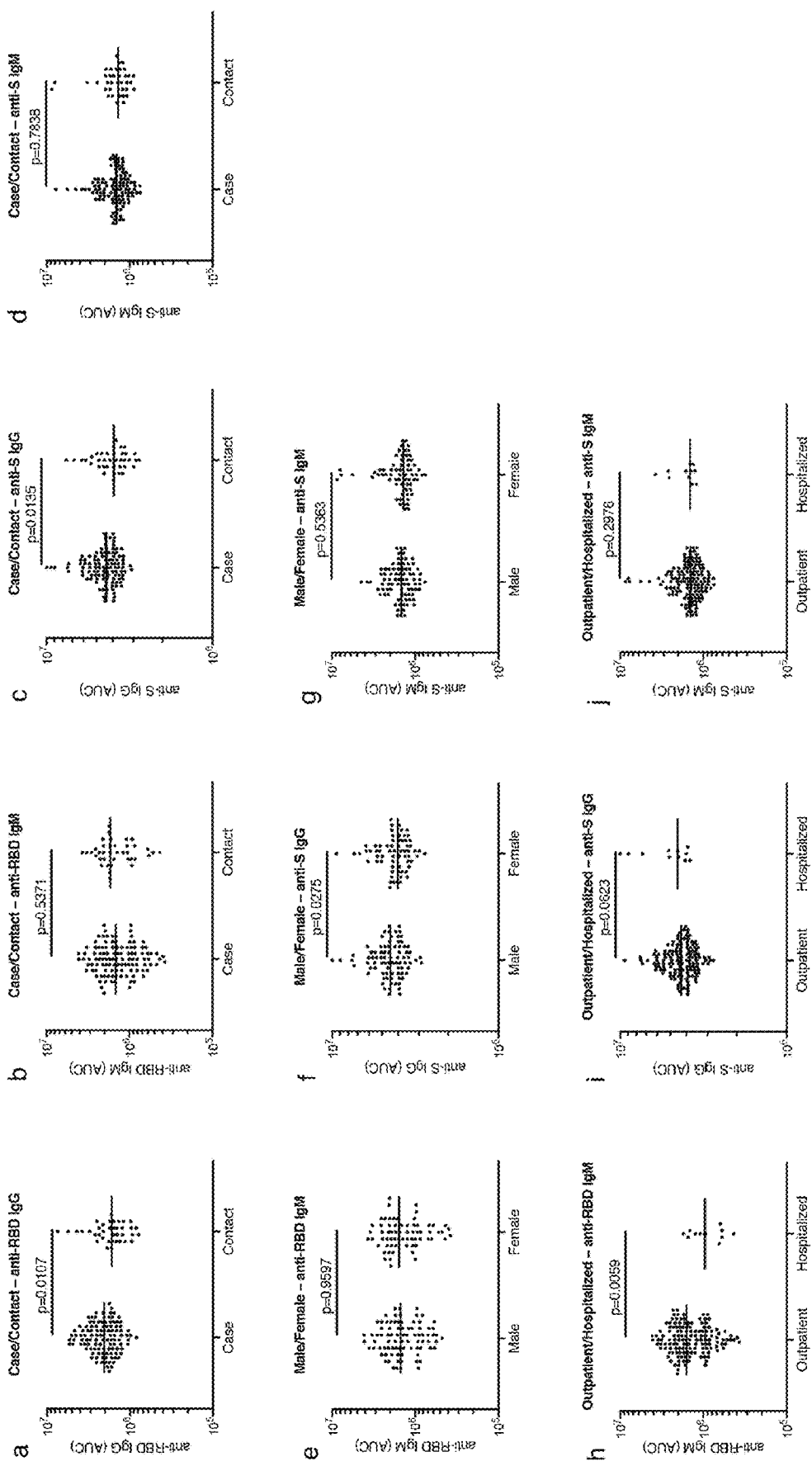
FIGS. 8A, 8B, 8C, 8D, 8E, 8F, 8G, 8H, 8I, and 8J

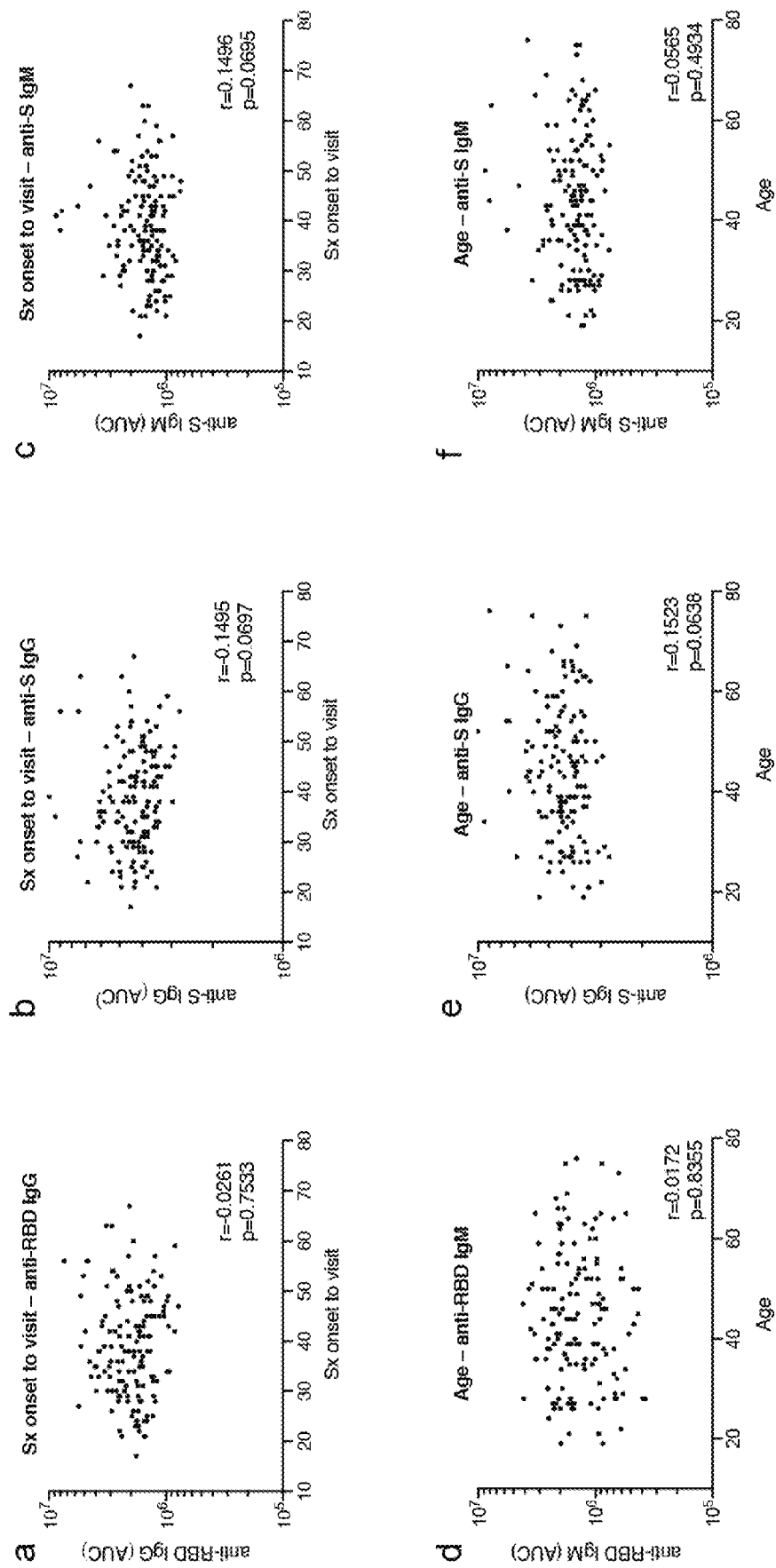
FIGS. 9A, 9B, 9C, 9D, 9E, and 9F

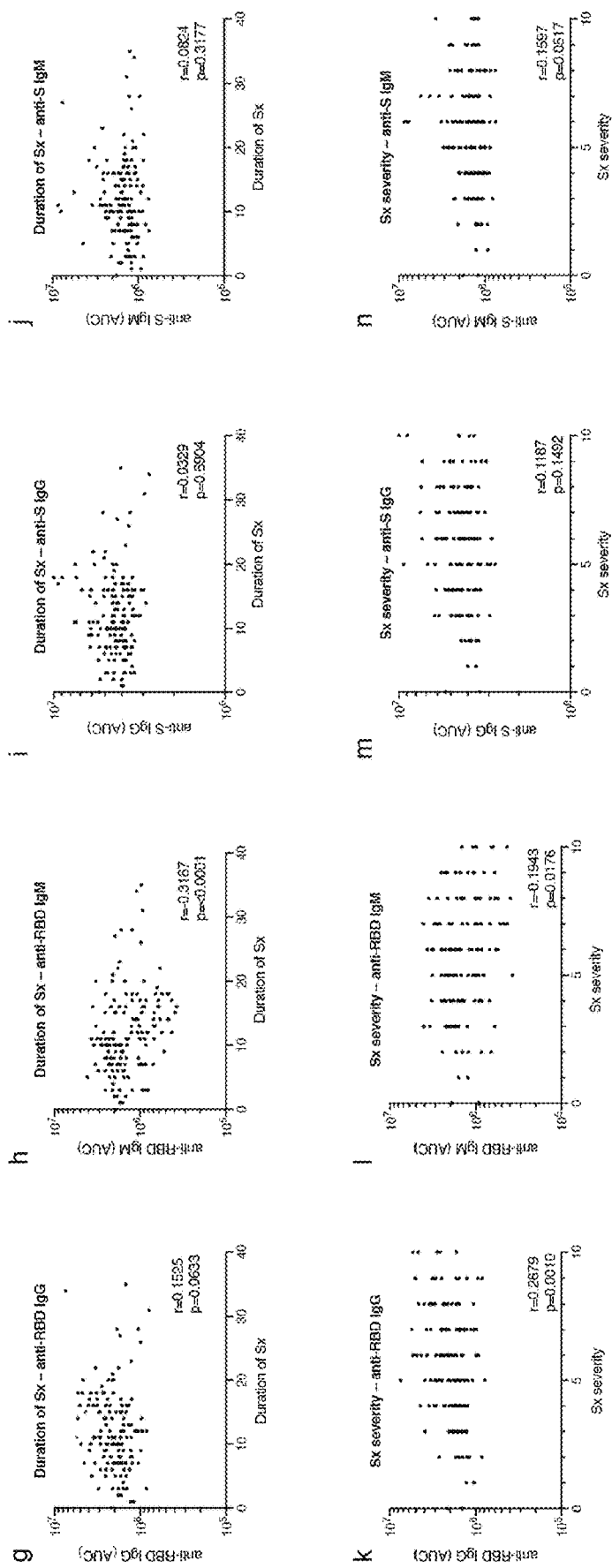
FIGS. 9G, 9H, 9I, 9J, 9K, 9L, 9M, and 9N

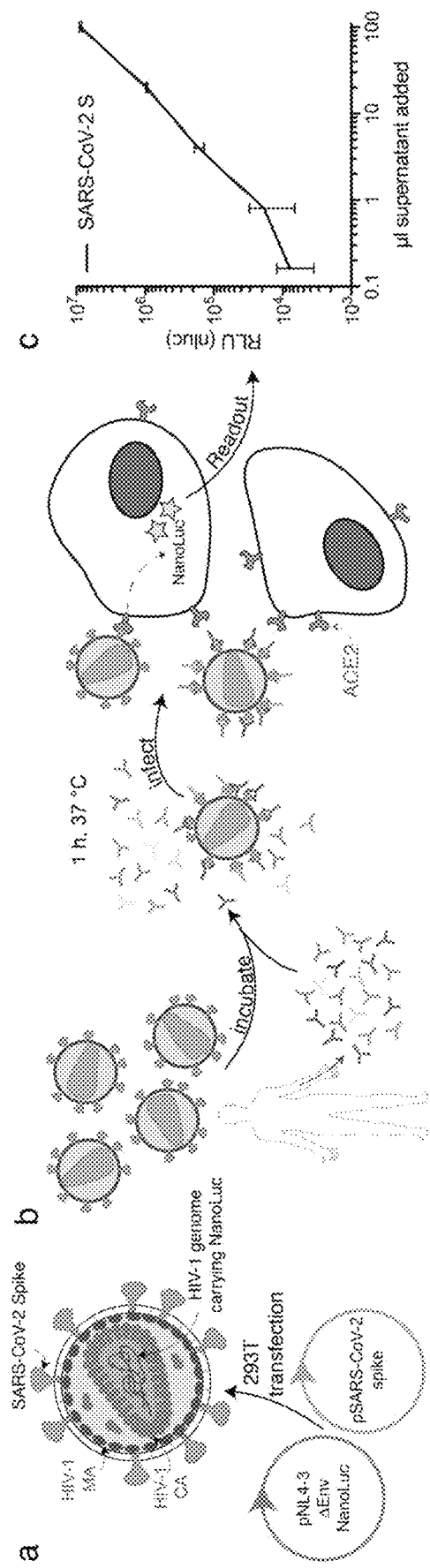
FIGS. 10A, 10B, and 10C

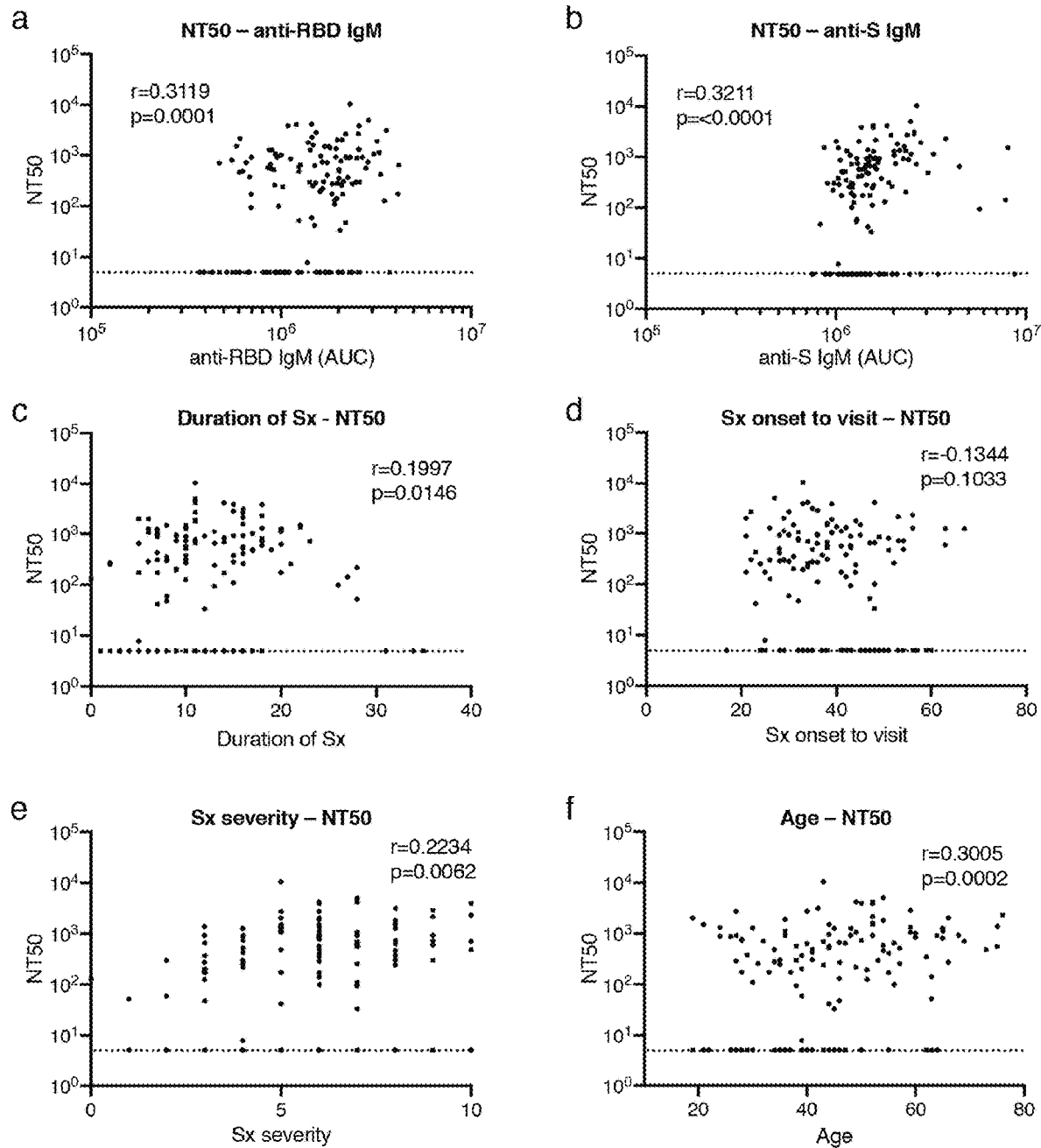
FIGS. 11A, 11B, 11C, 11D, 11E, and 11F

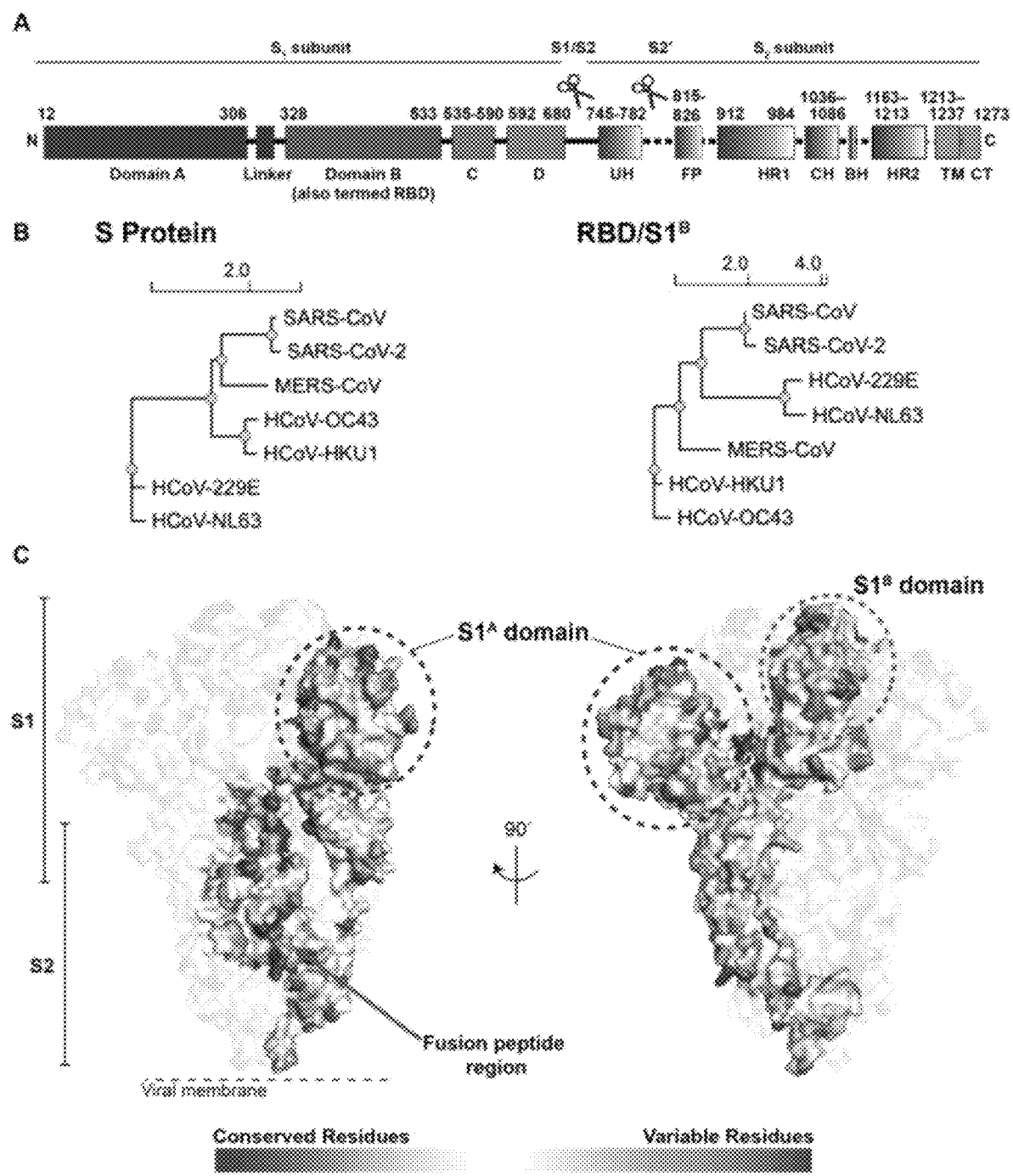
FIGS. 17A, 17B, and 17C

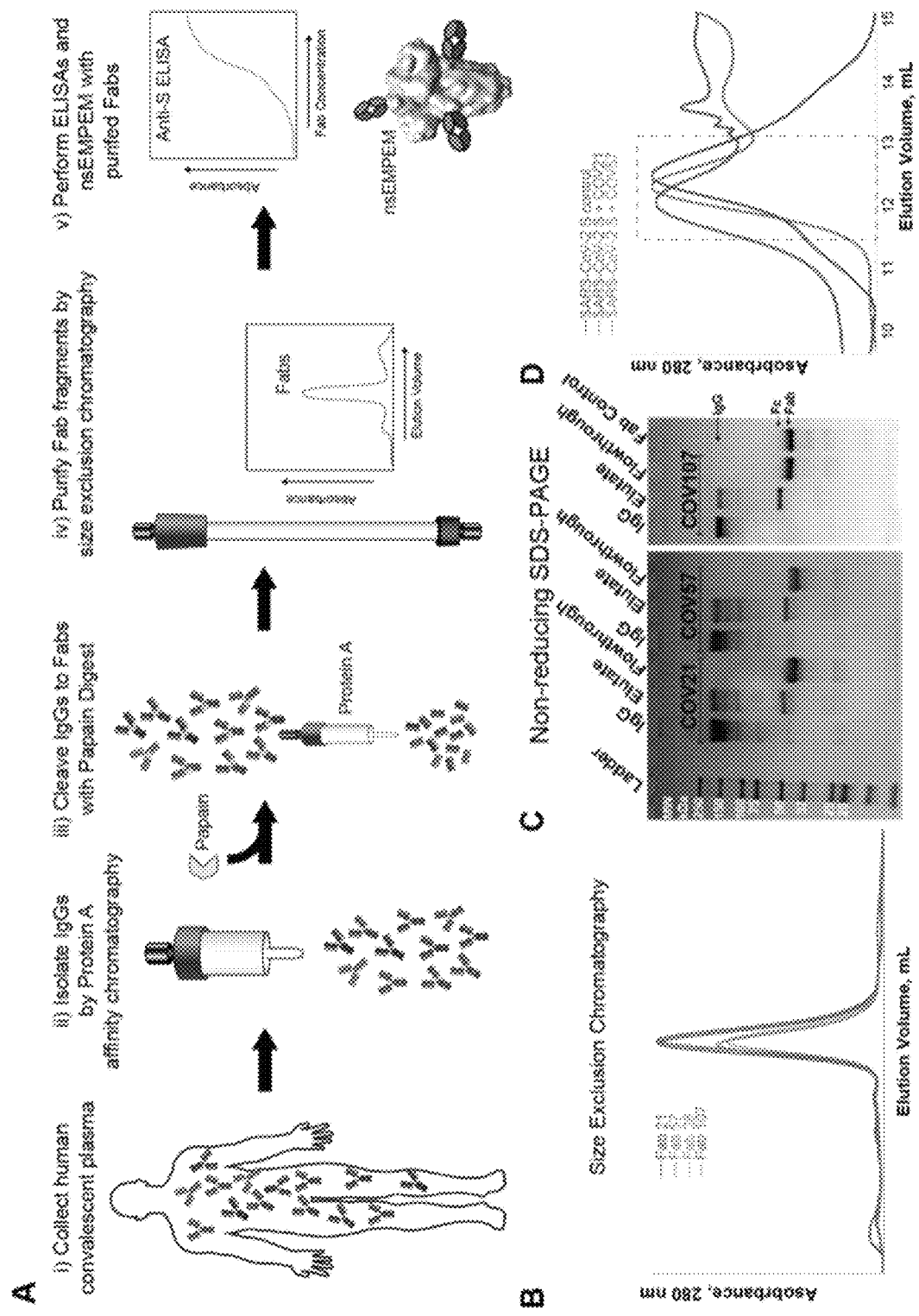
FIGS. 18A, 18B, and 18C

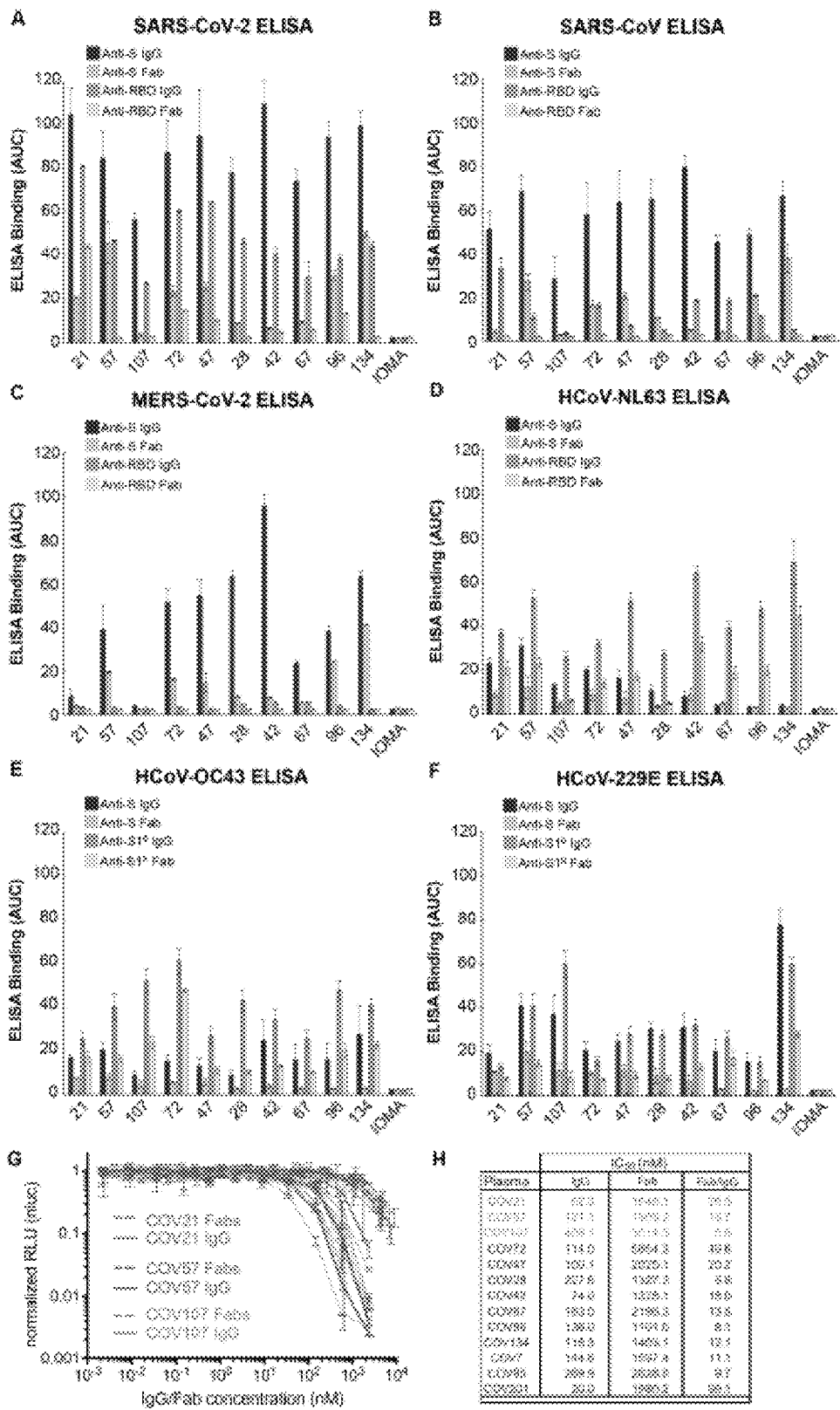
FIGS. 19A, 19B, 19C, 19D, 19E, 19F, 19G, and 19H

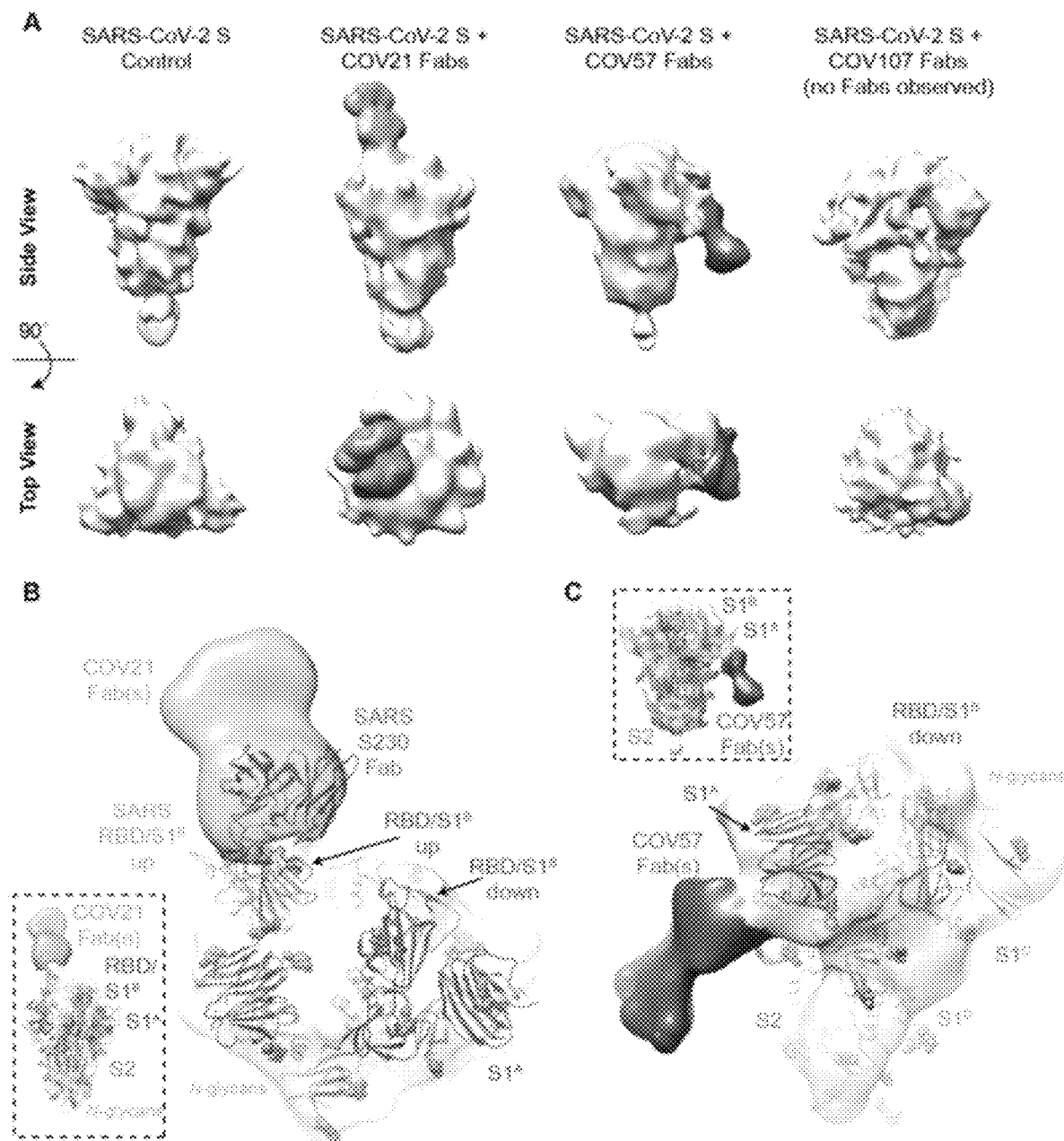
FIGS. 20A, 20B, and 20C

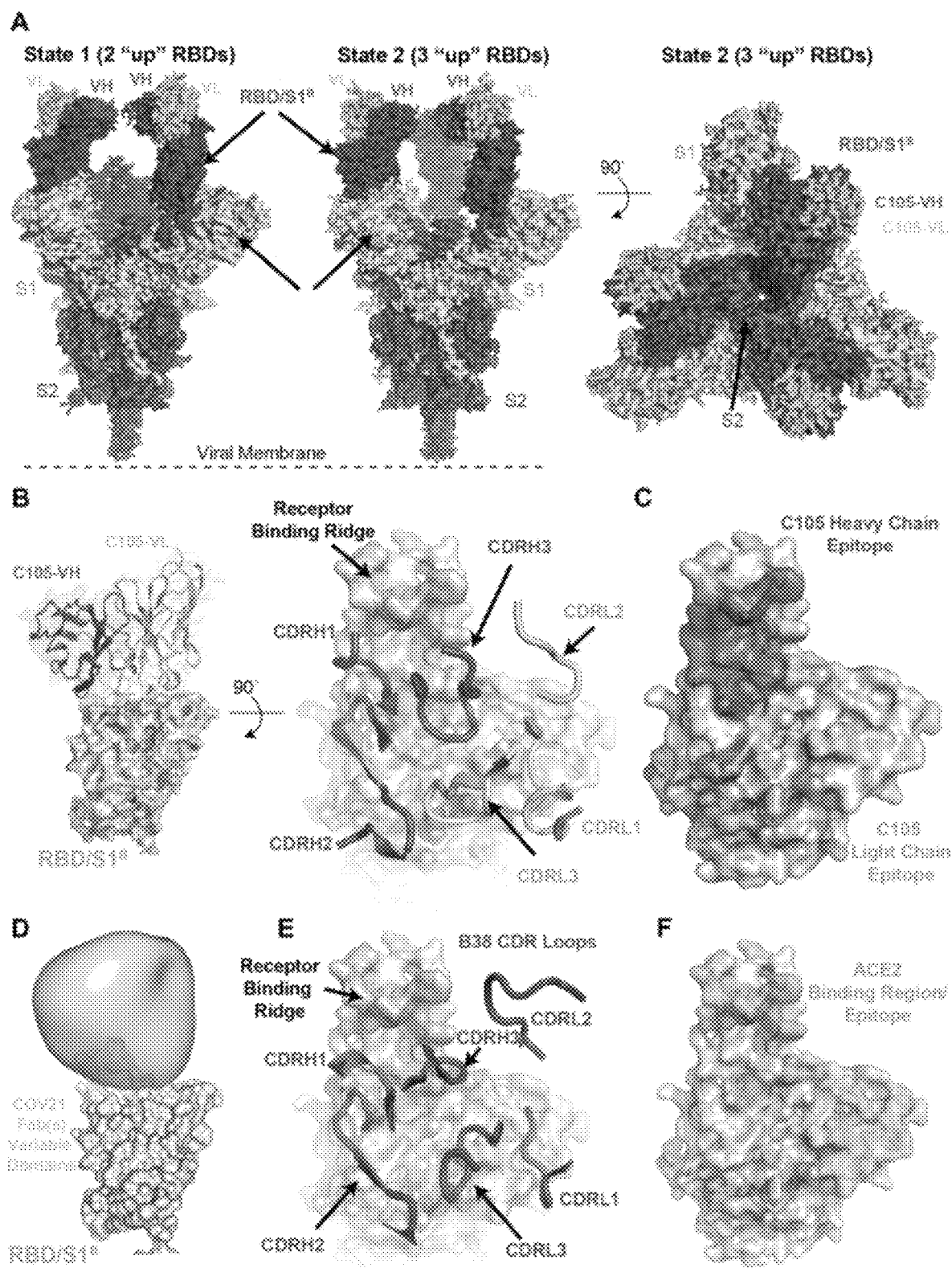
FIGS. 21A, 21B, 21C, 21D, 21E, and 21F

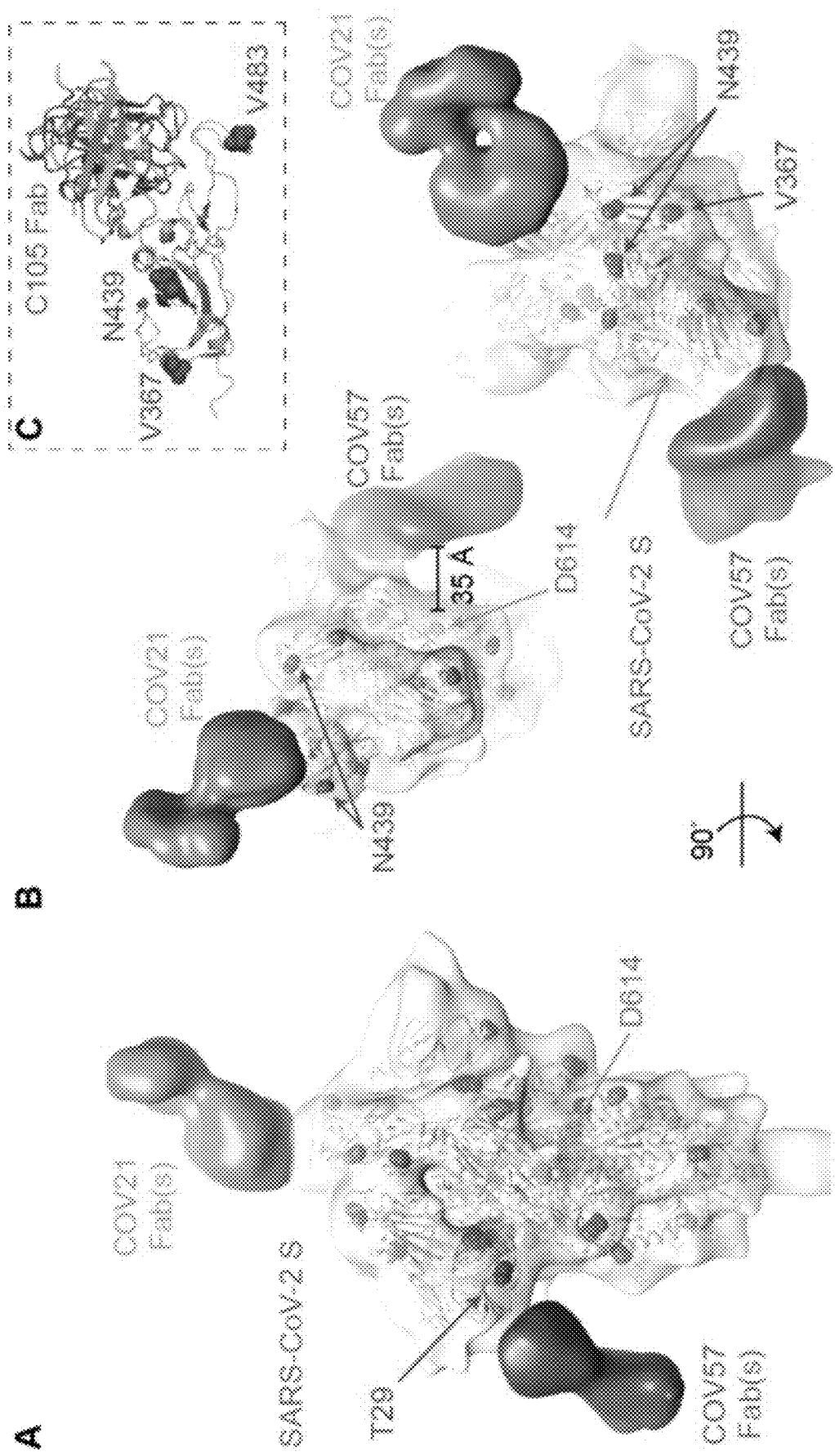
*FIGS. 22A, 22B, and 22C*

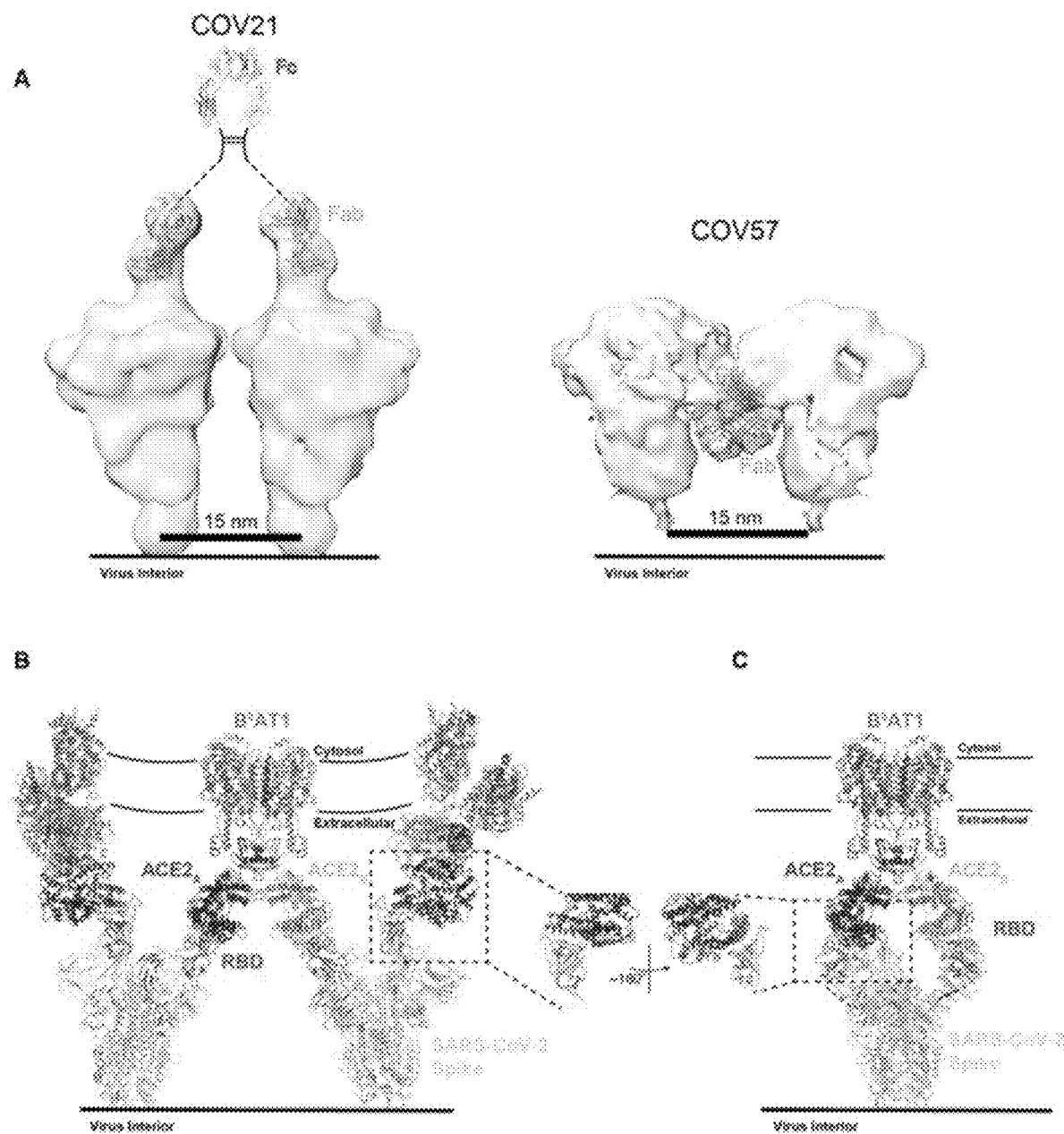
FIGS. 23A, 23B, and 23C

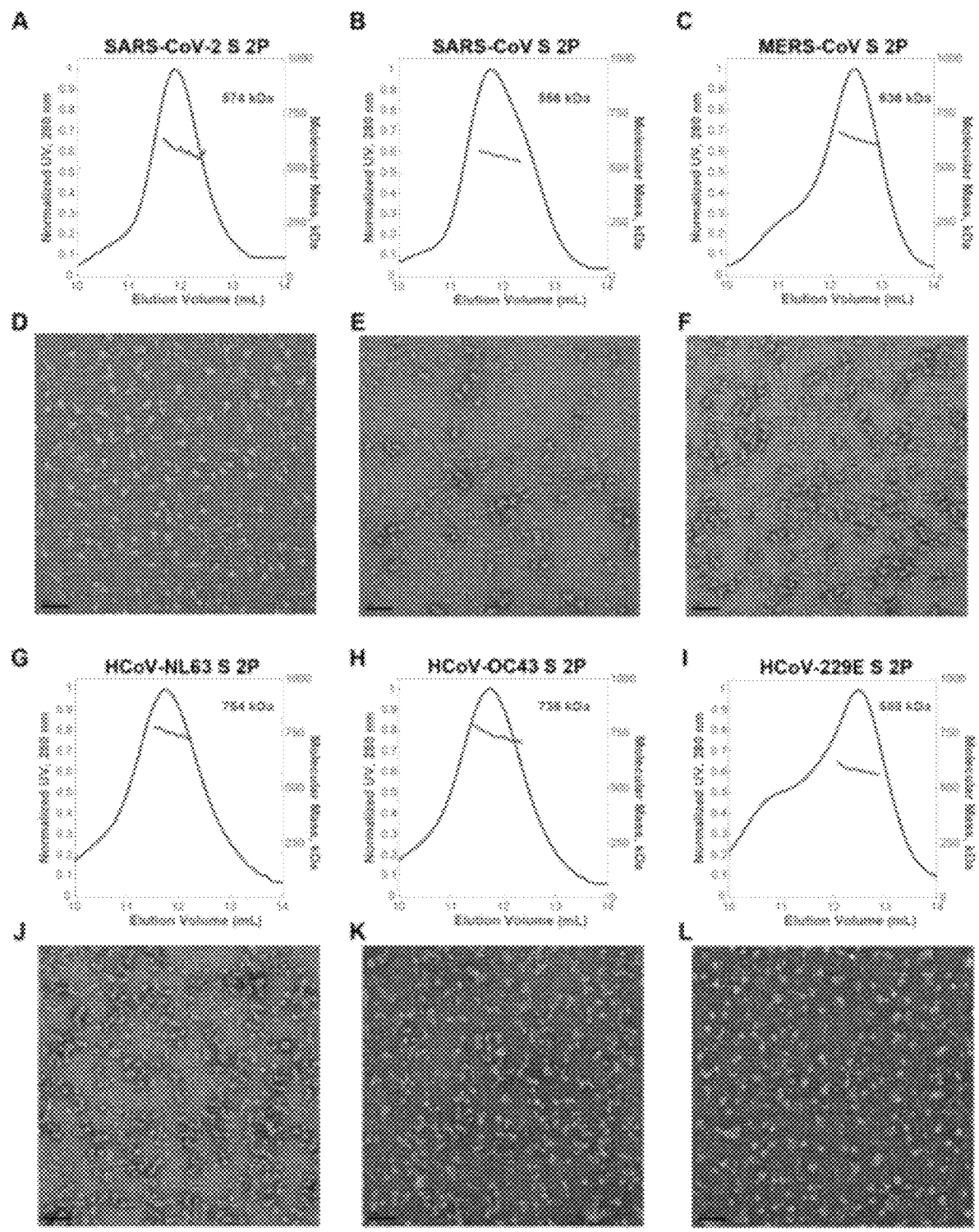
FIGS. 24A, 24B, 24C, 24D, 24E, 24F, 24G, 24H, 24I, 24J, 24K, and 24L

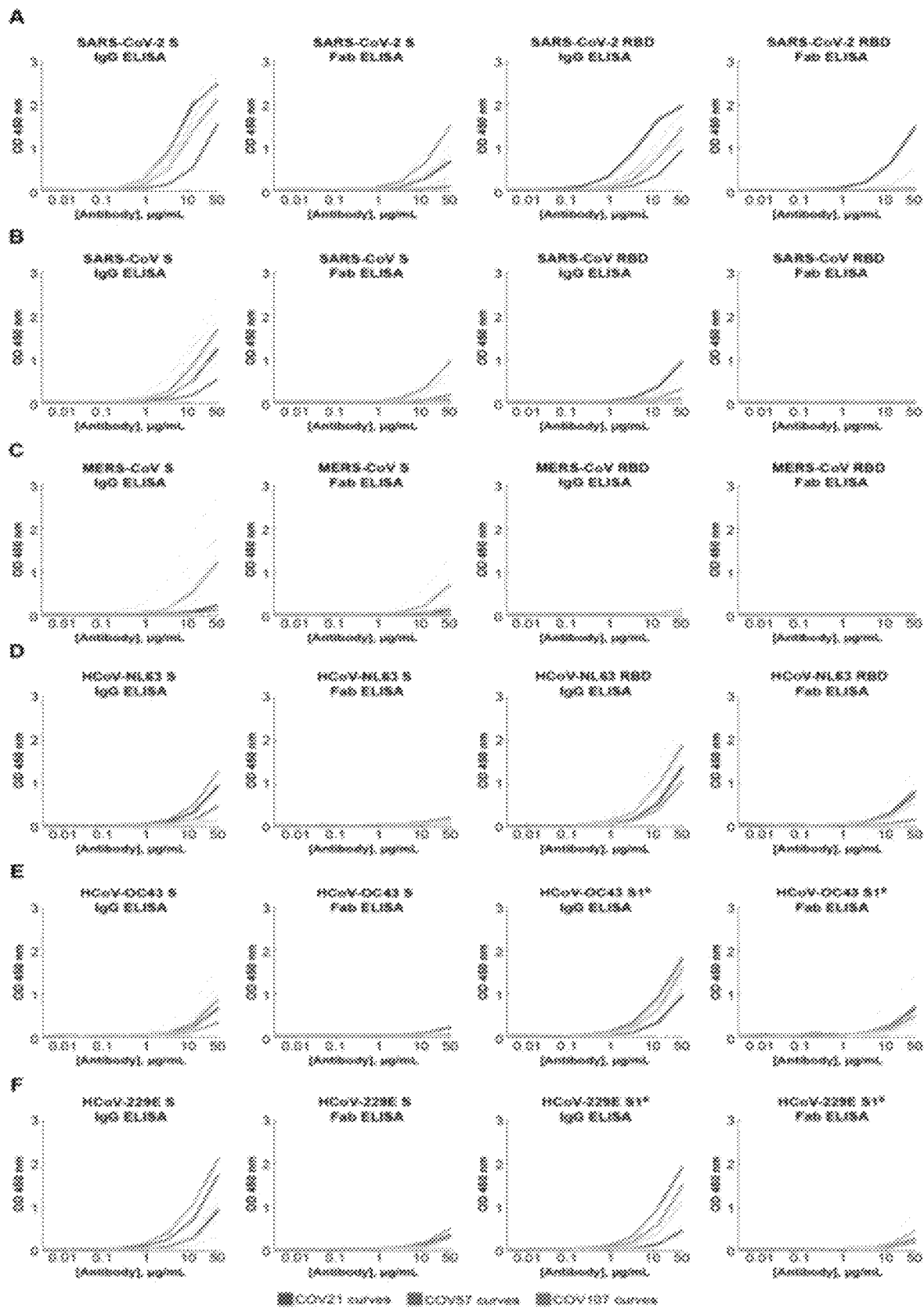
FIGS. 25A, 25B, 25C, 25D, 25E, and 25F

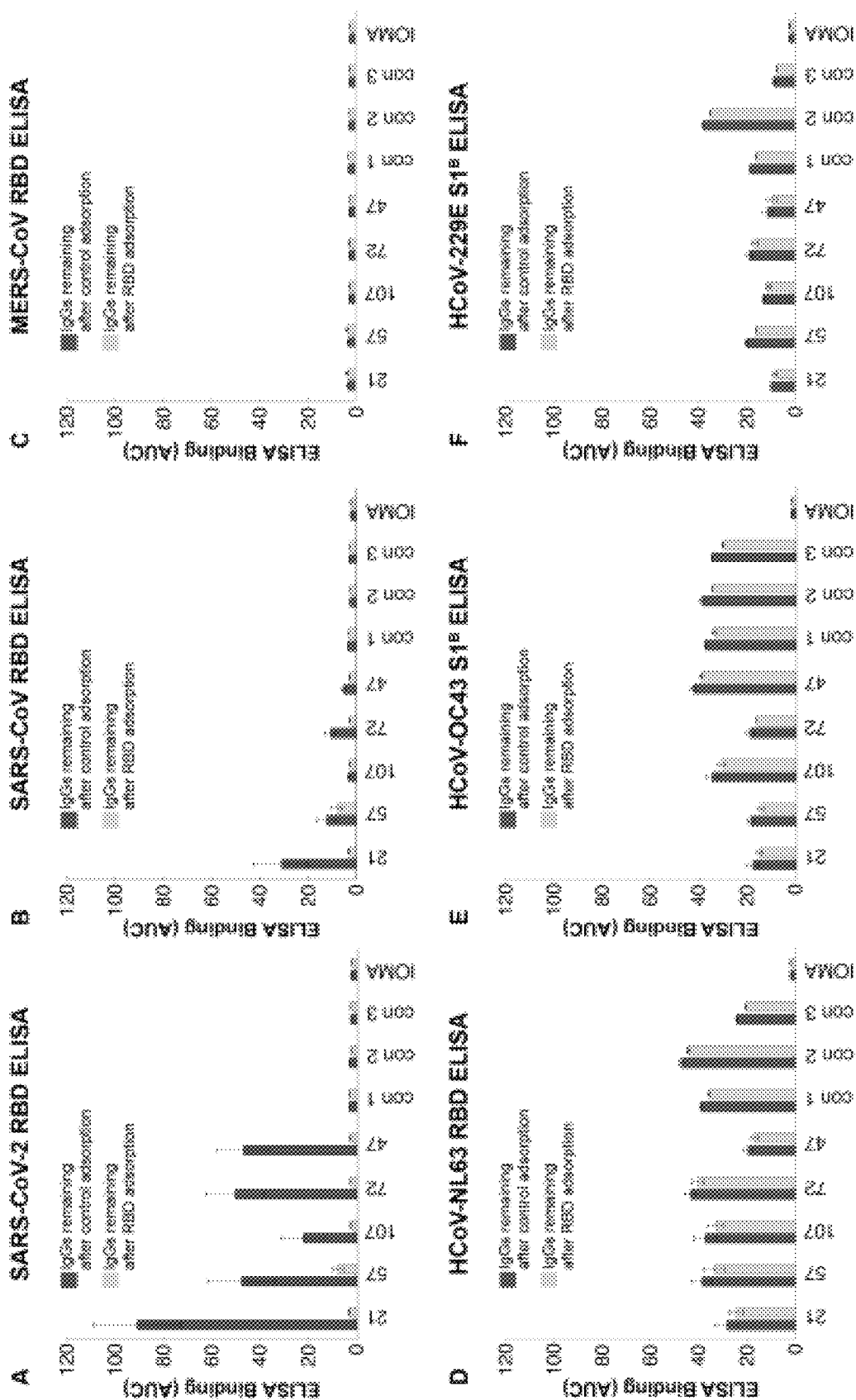
FIGS. 26A, 26B, 26C, 26D, 26E, and 26F

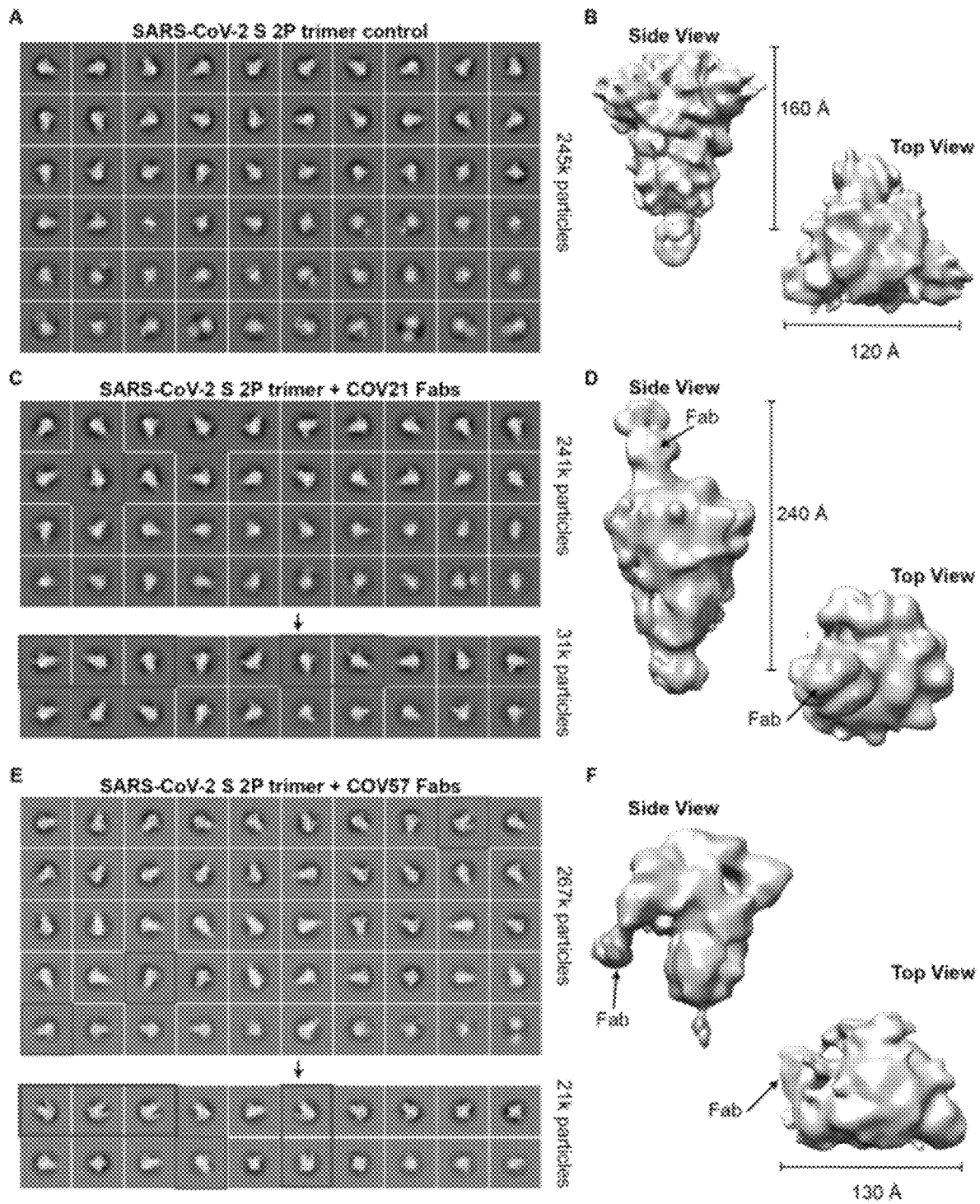
FIGS. 27A, 27B, 27C, 27D, 27E, and 27F

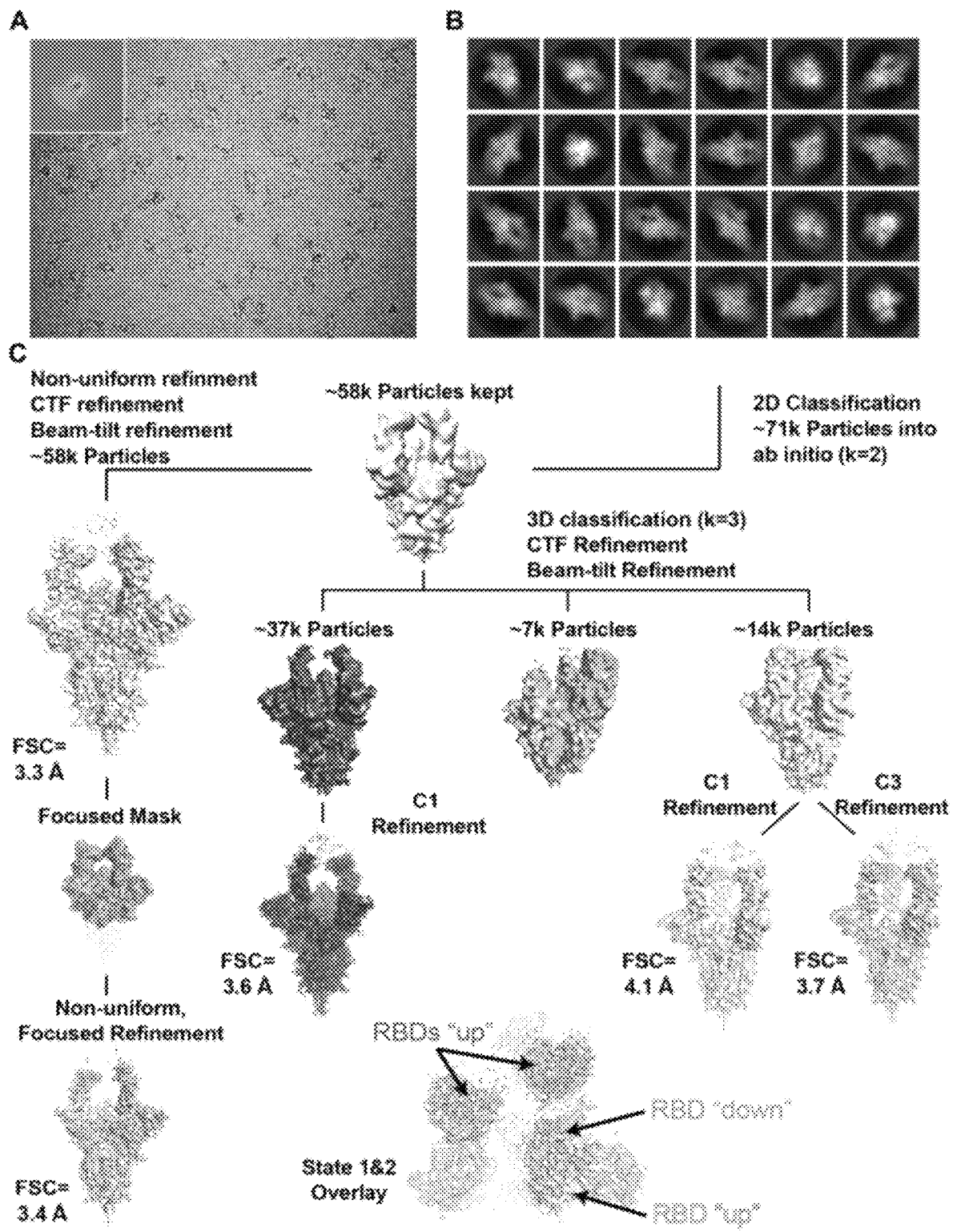
FIGS. 28A, 28B, and 28C

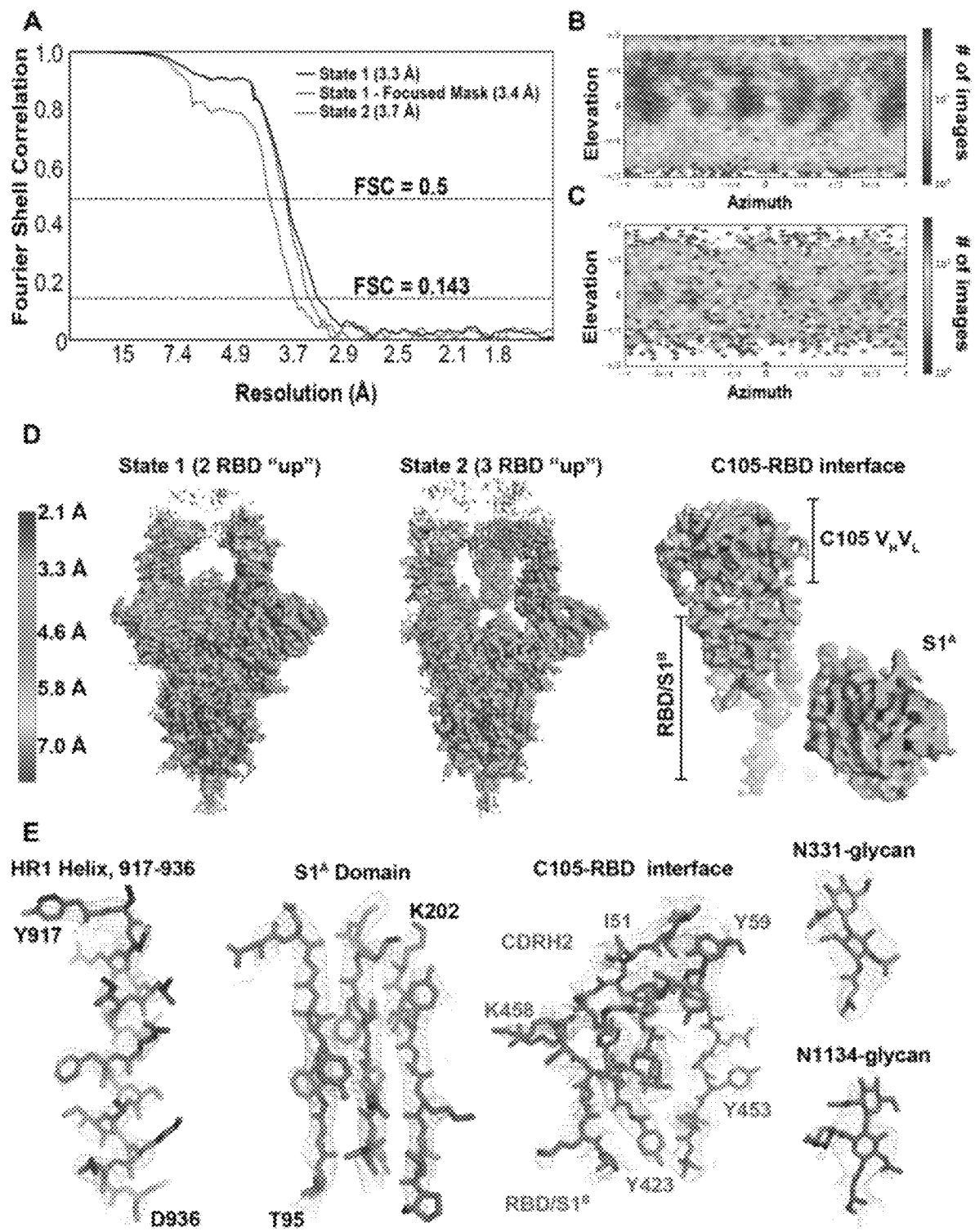
FIGS. 29A, 29B, 29C, 29D, and 29E

| | Lot | IC50 [ng/ml] | IC90 [ng/ml] |
|---|---|---|---|
| 986413 (C144') | Ref std Lot A1490-030 | 4.47 | 28.81 |
| | Tox DS Lot A2AA8-004 | 5.16 | 25.49 |
| | GMP DS Lot 20-C144-01 | 3.58 | 12.77 |
| 986414 (C135) | Ref std Lot A0793-089 | 10.16 | 131.10 |
| | Tox DS Lot A2AA8-003 | 13.68 | 98.26 |
| | GMP DS Lot 20-C135-01 | 11.64 | 83.52 |

C

D

| | Lot | IC50 [ng/ml] | IC90 [ng/ml] |
|---|---|---|---|
| 144' | GMP DS Lot 20-C144-01 | 3.58 | 12.77 |
| 135 | GMP DS Lot 20-C135-01 | 11.64 | 83.52 |
| 144'+135 | GMP DS-Lots | 9.09 | 32.12 |

# NEUTRALIZING ANTI-SARS-COV-2 ANTIBODIES AND METHODS OF USE THEREOF

CROSS-REFERENCE TO RELATED APPLICATIONS

This application claims priority under 35 U.S.C. § 119(e) to U.S. Provisional Patent Application No. 63/016,569, filed Apr. 28, 2020, to U.S. Provisional Patent Application No. 63/021,387, filed May 7, 2020, to U.S. Provisional Patent Application No. 63/032,112, filed May 29, 2020, to U.S. Provisional Patent Application No. 63/038,384, filed Jun. 12, 2020, and to U.S. Provisional Patent Application No. 63/119,088, filed Nov. 30, 2020. The foregoing applications are incorporated by reference herein in their entireties.

STATEMENT REGARDING FEDERALLY FUNDED RESEARCH

This invention was made with government support under grant nos. P01-AI138398-S1 and 2U19AI111825 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Jun. 8, 2021, is named 070413_20615_SL.txt and is 3,009,383 bytes in size.

FIELD OF THE INVENTION

The present invention relates to antibodies directed to epitopes of SARS-CoV-2 Coronavirus 2 ("SARS-CoV-2"). The present invention further relates to the preparation and use of broadly neutralizing antibodies directed to the SARS-CoV-2 spike (S) glycoproteins for the prevention and treatment of SARS-CoV-2 infection.

BACKGROUND OF THE INVENTION

SARS-CoV-2 is the virus that causes coronavirus disease 2019 (COVID-19). It contains four structural proteins, including spike (S), envelope (E), membrane (M), and nucleocapsid (N) proteins. Among them, S protein plays the most important roles in viral attachment, fusion, and entry, and it serves as a target for development of antibodies, entry inhibitors, and vaccines. The S protein mediates viral entry into host cells by first binding to a host receptor through the receptor-binding domain (RBD) in the S1 subunit and then fusing the viral and host membranes through the S2 subunit. SARS-CoV and MERS-CoV RBDs recognize different receptors. SARS-CoV recognizes angiotensin-converting enzyme 2 (ACE2) as its receptor, whereas MERS-CoV recognizes dipeptidyl peptidase 4 (DPP4) as its receptor. Similar to SARS-CoV, SARS-CoV-2 also recognizes ACE2 as its host receptor binding to viral S protein.

As of Apr. 25, 2020, a total of 2.84 million confirmed cases of COVID-19 were reported, including 199,000 deaths, in the United States and at least 85 other countries and/or territories. Currently, the intermediate host of SARS-CoV-2 is still unknown, and no effective prophylactics or therapeutics are available. This calls for the immediate development of vaccines and antiviral drugs for prevention and treatment of COVID-19.

In addition, due to the ability of SARS-CoV-2 to be spread through an airborne route, SARS-CoV-2 presents a particular threat to the health of large populations of people throughout the world. Accordingly, methods to immunize people before infection, diagnose infection, immunize people during infection, and treat infected persons infected with SARS-CoV-2 are urgently needed.

SUMMARY OF THE INVENTION

This disclosure addresses the need mentioned above in a number of aspects by providing broadly neutralizing anti-SARS-CoV-2 antibodies or antigen-binding fragments thereof.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is capable of neutralizing a plurality of SARS-CoV-2 strains.

In some embodiments, the antibody or antigen-binding fragment thereof comprises three heavy chain complementarity determining regions (HCDRs) (HCDR1, HCDR2, and HCDR3) of a heavy chain variable region having an amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and three light chain CDRs (LCDR1, LCDR2, and LCDR3) of a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, HCDR1, HCDR2, HCDR3, LCDR1, LCDR2, and LCDR3 comprise respective amino acid sequences of (i) SEQ ID NOs: 2878, 2880, 2882, 2890, 2892, and 2894; or (ii) SEQ ID NOs: 2902, 2904, 2906, 2914, 2916, and 2918.

In some embodiments, the antibody or antigen-binding fragment thereof comprises: (i) a heavy chain variable region having an amino acid sequence with at least 75% identity to SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; or (ii) a light chain variable region having an amino acid sequence with at least 75% identity to SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having an amino acid sequence with at least 75% identity to SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and (ii) a light chain variable region having an amino acid sequence with at least 75% identity to SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having the amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; or (ii) a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having the amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and (ii) a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises a heavy chain variable region and a light chain variable region that comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, 167-168, 169-170, 171-172, 173-174, 175-176, 177-178, 179-180, 181-182, 183-184, 185-186, 187-188, 2876 and 2888, or 2900 and 2912.

In some embodiments, the antibody or antigen-binding fragment thereof comprises a heavy chain variable region and a light chain variable region that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the antibody or antigen-binding fragment thereof comprises a heavy chain/light chain sequence pair of SEQ ID NOs: 2886/2898, 2887/2899, 2910/2921, or 2911/2922.

In some embodiments, the antibody or antigen-binding fragment thereof is a multivalent antibody that comprises (a) a first target binding site that specifically binds to an epitope within the S polypeptide, and (b) a second target binding site that binds to a different epitope on the S polypeptide or a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or antigen-binding fragment thereof is detectably labeled or conjugated to a toxin, a therapeutic agent, a polymer, a receptor, an enzyme or a receptor ligand. In some embodiments, the polymer is polyethylene glycol (PEG).

For example, an antibody of the invention may be coupled to a toxin. Such antibodies may be used to treat animals, including humans, that are infected with the virus that is etiologically linked to SARS-CoV-2. For example, an antibody that binds to the spike protein of the coronavirus that is etiologically linked to SARS-CoV-2 may be coupled to a tetanus toxin and administered to an animal suffering from infection by the aforementioned virus. The toxin-coupled antibody is thought to bind to a portion of a spike protein presented on an infected cell, and then kill the infected cell.

An antibody of the invention may be coupled to a detectable tag. Such antibodies may be used within diagnostic assays to determine if an animal, such as a human, is infected with SARS-CoV-2. Examples of detectable tags include fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin).

In another aspect, this disclosure provides a pharmaceutical composition comprising: the antibody or antigen-binding fragment thereof of any one of the preceding claims and optionally a pharmaceutically acceptable carrier or excipient.

In some embodiments, the pharmaceutical comprises two or more of the antibody or antigen-binding fragment thereof of described above, such as any combinations of the antibody or antigen-binding fragment thereof comprising a heavy chain and a light chain that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the two or more of the antibody or antigen-binding fragment thereof comprise: (1) a first antibody set comprising: (i) a first antibody or antigen-binding fragment thereof comprising a heavy chain variable region and a light chain variable region comprising the respective amino acid sequences of SEQ ID NOs: 57-58; and (ii) a second antibody or antigen-binding fragment thereof comprising a heavy chain variable region and a light chain variable region comprising the respective amino acid sequences of SEQ ID NOs: 1-2, 55-56, 57-58, 65-66, 81-82, or 85-86; or (2) a second antibody set comprising: (a) a third antibody or antigen-binding fragment thereof comprising a heavy chain variable region and a light chain variable region comprising the respective amino acid sequences of of SEQ ID NOs: 13-14, 49-50, 85-86, 113-114, 125-126, 2876 and 2888, or 2900 and 2912; and (b) a fourth antibody or antigen-binding fragment thereof comprising a heavy chain variable region and a light chain variable region comprising the respective amino acid sequences of of SEQ ID NOs: 13-14, 49-50, 85-86, 113-114, 125-126, 2876 and 2888, or 2900 and 2912, wherein the third antibody is different from the fourth antibody.

In some embodiments, the pharmaceutical composition further comprises a second therapeutic agent. In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

Also within the scope of this disclosure is use of the pharmaceutical composition, as described above, in the preparation of a medicament for the diagnosis, prophylaxis, treatment, or combination thereof of a condition resulting from a SARS-CoV-2.

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described. Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof; and (c) purifying the antibody or fragment from the cultured cell or the medium of the cell.

In another aspect, this disclosure provides a kit comprising a pharmaceutically acceptable dose unit of the antibody or antigen-binding fragment thereof of or the pharmaceutical composition as described above. Also within the scope of this disclosure is a kit for the diagnosis, prognosis or monitoring the treatment of SARS-CoV-2 in a subject, comprising: the antibody or antigen-binding fragment thereof as described; and a least one detection reagent that binds specifically to the antibody or antigen-binding fragment thereof.

In yet another aspect, this disclosure further provides a method of neutralizing SARS-CoV-2 in a subject, comprising administering to a subject in need thereof a therapeutically effective amount of the antibody or antigen-binding fragment thereof or a therapeutically effective amount of the pharmaceutical composition, as described above.

In yet another aspect, this disclosure additionally provides a method of preventing or treating a SARS-CoV-2 infection, comprising administering to a subject in need thereof a therapeutically effective amount of the antibody or antigen-binding fragment thereof or a therapeutically effective amount of the pharmaceutical composition, as described above.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment or a therapeutically effective amount of the pharmaceutical composition described above, as described above, wherein the first antibody or antigen-binding fragment thereof and the second antibody or antigen binding fragment thereof exhibit synergistic activity.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment or a therapeutically effective amount of the pharmaceutical composition described above, as described above, wherein the first antibody or antigen-binding fragment thereof and the second antibody or antigen binding fragment thereof exhibit synergistic activity. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the first antibody or antigen-binding fragment thereof comprises a heavy chain variable region and a light chain variable region comprising the respective amino acid sequences of SEQ ID NOs: 57-58 and the second antibody or antigen-binding fragment thereof comprises a heavy chain variable region and a light chain variable region comprising the respective amino acid sequences of SEQ ID NOs: 1-2, 55-56, 57-58, 65-66, 81-82, or 85-86.

In some embodiments, the first antibody or antigen-binding fragment thereof comprises a heavy chain variable region and a light chain variable region comprising the respective amino acid sequences of SEQ ID NOs: 13-14, 49-50, 85-86, 113-114, 125-126, 2876 and 2888, or 2900 and 2912, and the second antibody or antigen-binding fragment thereof comprises a heavy chain variable region and a light chain variable region comprising the respective amino acid sequences of SEQ ID NOs: 13-14, 49-50, 85-86, 113-114, 125-126, 2876 and 2888, or 2900 and 2912, wherein the first antibody and the second antibody are different.

In some embodiments, the method comprises administering to the subject a therapeutically effective amount of a second therapeutic agent or therapy. In some embodiments, the antibody or antigen-binding fragment thereof comprises a heavy chain variable region and a light chain variable region comprising the respective amino acid sequences of SEQ ID NOs: 57-58; and the second therapeutic agent or therapy comprises an antibody or antigen-binding fragment thereof comprising a heavy chain variable region and a light chain variable region that comprise the respective amino acid sequences of SEQ ID NOs: 1-2, 55-56, 57-58, 65-66, 81-82, or 85-86.

In some embodiments, the second therapeutic agent comprises an anti-inflammatory drug or an antiviral compound. In some embodiments, the antiviral compound comprises a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

In another aspect, this disclosure further provides a method for detecting the presence of SARS CoV-2 in a sample comprising the steps of: (i) contacting a sample with the antibody or antigen-binding fragment thereof described above; and (ii) determining binding of the antibody or antigen-binding fragment to one or more SARS CoV-2 antigens, wherein binding of the antibody to the one or more SARS CoV-2 antigens is indicative of the presence of SARS CoV-2 in the sample. In some embodiments, the sample is a blood sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

The foregoing summary is not intended to define every aspect of the disclosure, and additional aspects are described in other sections, such as the following detailed description. The entire document is intended to be related as a unified disclosure, and it should be understood that all combinations of features described herein are contemplated, even if the combination of features are not found together in the same sentence, or paragraph, or section of this document. Other features and advantages of the invention will become apparent from the following detailed description. It should be understood, however, that the detailed description and the specific examples, while indicating specific embodiments of the disclosure, are given by way of illustration only, because various changes and modifications within the spirit and scope of the disclosure will become apparent to those skilled in the art from this detailed description.

BRIEF DESCRIPTION OF THE FIGURES

FIGS. 3A, 3B, 3C, 3D, 3E, 3F, 3G, and 3H (collectively "FIG. 3") are a set of graphs showing results of ELISAs measuring plasma reactivity to RBD (FIGS. 3A and 3B) and S protein (FIGS. 3C and 3D). Left shows optical density units at 450 nm (OD, Y axis) and reciprocal plasma dilutions (X axis). Negative controls in black; individuals 21, and 47 in blue and red lines and arrowheads, respectively. Right shows normalized area under the curve (AUC) for 8 controls and each of 149 individuals in the cohort. FIG. 3E shows symptom (Sx) onset to time of sample collection in days (X axis) plotted against normalized AUC for IgM binding to RBD (Y axis); r=0.5517 and p=<0.0001. FIG. 3F shows participant age in years (X axis) plotted against normalized AUC for IgG binding to RBD (Y axis); r=0.1827 and p=0.0258. The r and p values for the correlations in FIGS. 3E and 3F were determined by two-tailed Spearman's. FIG. 3G shows normalized AUC of anti-RBD IgG ELISA for outpatients (n=138) and hospitalized (n=11) individuals; p=0.0178. FIG. 3H shows normalized AUC of anti-RBD IgG ELISA for males (n=83) and females (n=66); p=0.0063. For FIGS. 3G and 3H, horizontal bars indicate median values. Statistical significance was determined using two-tailed Mann-Whitney U test.

FIGS. 4A, 4B, 4C, 4D, 4E, and 4F (collectively "FIG. 4") are a set of graphs showing neutralization of SARS-CoV-2 pseudovirus by plasma. FIG. 4A shows normalized relative luminescence values (RLU, Y axis) in cell lysates of 293 $T_{ACE2}$ cells 48 hours after infection with nanoluc-expressing SARS-CoV-2 pseudovirus in the presence of increasing concentrations of plasma (X axis) derived from 149 participants (grey, except individuals 21 and 47 in blue and red lines, bars and arrowheads, respectively) and 3 negative controls (black lines). Mean of duplicates; representative of two independent experiments. FIG. 4B shows ranked average half-maximal inhibitory plasma neutralizing titer ($NT_{50}$) for the 59 of 149 individuals with $NT_{50}s>500$ and individual 107. Asterisks indicate donors from which antibody sequences were derived. FIG. 4C shows normalized AUC for anti-RBD IgG ELISA (X axis) plotted against $NT_{50}$ (Y axis); r=0.6432, p=<0.0001. FIG. 4D shows normalized AUC for anti-S IgG ELISA (X axis) plotted against $NT_{50}$ (Y axis); r=0.6721, p=<0.0001. The r and p values for the correlations in FIGS. 4C and 4D were determined by two-tailed Spearman's. FIG. 4E shows $NT_{50}$ for outpatients (n=138) and hospitalized (n=11) individuals; p=0.0495. FIG. 4F shows $NT_{50}$ for males (n=83) and females (n=66) in the cohort; p=0.0031. Statistical significance in e and f was determined using two-tailed Mann-Whitney U test and horizontal bars indicate median values. Dotted lines in FIGS. 4E and 4F ($NT_{50}=5$) represents lower limit of detection (LLOD). Samples with neutralizing titers below 1:50 were plotted at LLOD.

FIGS. 5A, 5B, 5C, and 5D (collectively "FIG. 5") are a set of graphs showing activities of anti-SARS-CoV-2 RED antibodies. FIG. 5A shows representative flow cytometry plots displaying dual AF647- and PE-RBD binding B cells in control and 6 study individuals (for gating strategy see FIG. 12). Percentages of antigen specific B cells are indicated. Control is a healthy control sample obtained pre-COVID-19. FIG. 5B is a set of pie charts depicting the distribution of antibody sequences from 6 individuals. The number in the inner circle indicates the number of sequences analyzed for the individual denoted above the circle. White indicates sequences isolated only once, and grey or colored pie slices are proportional to the number of clonally related sequences. Red, blue, orange, and yellow pie slices indicate clones that share the same IGHV and IGLV genes. FIG. 5C is circos plot showing sequences from all 6 individuals with clonal relationships depicted as in FIG. 5B. Interconnecting lines indicate the relationship between antibodies that share V and J gene segment sequences at both IGH and IGL. Purple, green, and gray lines connect related clones, clones and singles, and singles to each other, respectively. FIG. 5D shows sample sequence alignment for antibodies originating from different individuals that display highly similar IGH V(D)J and IGL VJ sequences including CDR3s. Amino acid differences in CDR3s to the bolded reference sequence above are indicated in red and dots represent identities. FIG. 5D discloses SEQ ID NOS 598, 602, 1434, 1438, 2445, 2449, 578, 582, 586, 1754, 1758, 600, 600, 1436, 600, 2487, 600, 580, 584, 580, 580, and 580, respectively, in order of column.

FIGS. 6A, 6B, 6C, 6D, 6E, 6F, 6G, 6H, 6I, 6J, 6K, 6L, 6M, 6N, 6O, 6P, 6Q, and 6R (collectively "FIG. 6") are a set of graphs showing anti-SARS-CoV-2 RBD antibody reactivity. FIG. 6A is a graph showing the results of ELISA assays measuring monoclonal antibody binding to RBD. Optical density units at 450 nm (OD, Y axis) vs. antibody concentrations (X axis); 94 samples and 1 isotype control. C121, C135 C144 and isotype control in red, green, purple, and black respectively, in all panels. FIG. 6B is a graph showing normalized relative luminescence values (RLU, Y axis) in cell lysates of $293T_{ACE2}$ cells 48 hours after infection with SARS-CoV-2 pseudovirus in the presence of increasing concentrations of monoclonal antibodies (X axis). 89 samples and 1 isotype control. FIG. 6C shows normalized RLU for SARS-CoV-2 pseudovirus neutralization (Y axis) vs. titration of monoclonal antibodies C121, C135 and C144. FIG. 6D shows SARS-CoV-2 real virus neutralization assay. Normalized infected cells (Y axis, determined by dividing the amount of infection per well by the average of control wells infected in the absence of antibodies) vs. titration of monoclonal antibodies C121, C135, and C144. FIGS. 6A, 6B, 6C, and 6D show a representative of two independent experiments. In FIG. 6B and FIG. 6C is mean of duplicates and in FIG. 6D is mean with a standard deviation of triplicates. FIG. 6E shows $IC_{50}s$ for antibodies assayed in FIGS. 6B and 6D, the average value of at least two experiments is shown. Samples with $IC_{50}s$ above 1 mg/ml were plotted at 1 μg/ml; n=89 (pseudovirus) and n=3 (virus), respectively. FIG. 6F is a diagrammatic representation of biolayer interferometry experiment. FIG. 6G is a graph showing binding of C144, C101, C121, C009, C135, and CR3022 to RBD. FIGS. 6H, 6I, 6J, 6K, 6L, 6M, and 6N shows secondary antibody binding to preformed IgG-RBD complexes (Ab1). The table displays the shift in nanometers after second antibody (Ab2) binding to the antigen in the presence of the first antibody (Ab1). Values are normalized by the subtraction of the autologous antibody control. Representative of two experiments. FIGS. 6O, 6P, and 6Q show representative 2D-class averages and 3D reconstructed volumes for SARS-CoV-S 2P trimers complexed with C002, C119, and C121 Fabs. 2D class averages with observable Fab density are boxed. FIG. 6R shows overlay of S-Fab complexes with fully-occupied C002 (blue), C121 (magenta) and C119 (orange) Fabs. The SARS-CoV-2 S model from PDB 6VYB was fit into the density and the SARS-CoV mAb S230 (PDB 6NB6) is shown as a reference (green ribbon).

FIGS. 7A, 7B, 7C, 7D, 7E, 7F, 7G, 7H, 7I, 7J, 7K, and 7L (collectively "FIG. 7") are a set of graphs showing clinical correlates. FIG. 7A shows summary of the cohort's characteristics. FIG. 7B shows age distribution (Y axis) for all males (n=83) and females (n=66) in the cohort; p=0.2074. FIG. 7C shows duration of symptoms in days (Y axis) for all males (n=83) and females (n=66) in the cohort; p=0.8704. FIG. 7D shows time between symptom onset and plasma collection (Y axis) for all males (n=83) and females (n=66) in the cohort; p=0.5514. FIG. 7E shows subjective symptom severity on a scale of 0-10 (Y axis) for all males (n=83) and females (n=66) in the cohort; p=0.1888. FIG. 7F shows age distribution (Y axis) for all cases (n=111) and contacts (n=38) in the cohort; p=0.0305. FIG. 7G shows duration of symptoms in days (Y axis) for all cases (n=111) and contacts (n=38) in the cohort; p=0.1241. FIG. 7H shows time between symptom onset and plasma collection in days (Y axis) for all cases (n=111) and contacts (n=38) in the cohort; p=0.1589. FIG. 7I shows symptom severity (Y axis) for all cases (n=111) and contacts (n=38) in the cohort; p=0.0550. FIG. 7J shows age distribution (Y axis) for all outpatient (n=138) and hospitalized (n=11) participants; p=0.0024. FIG. 7K shows duration of symptoms in days (Y axis) for all outpatient (n=138) and hospitalized (n=11) participants in the cohort; p=<0.0001. FIG. 7L shows time between symptom onset and plasma collection in days (Y axis) for all outpatient (n=138) and hospitalized (n=11) participants in the cohort; p=0.0001. Horizontal bars indicate median values. Statistical significance was determined using two-tailed Mann-Whitney U test.

FIGS. 8A, 8B, 8C, 8D, 8E, 8F, 8G, 8H, 8I, and 8J (collectively "FIG. 8") are a set of graphs showing clinical correlates of plasma antibody titers. FIG. 8A shows normalized AUC for IgG anti-RBD (Y axis) for all cases (n=111) and contacts (n=38) in the cohort; p=0.0107. FIG. 8B shows normalized AUC for IgM anti-RBD (Y axis) for all cases (n=111) and contacts (n=38) in the cohort; p=0.5371. FIG. 8C shows normalized AUC for IgG anti-S (Y axis) for all cases (n=111) and contacts (n=38) in the cohort; p=0.0135. FIG. 8D shows normalized AUC for IgM anti-S(Y axis) for all cases (n=111) and contacts (n=38) in the cohort; p=0.7838. FIG. 8E shows normalized AUC for IgM anti-RBD (Y axis) for all males (n=83) and females (n=66) in the cohort; p=0.9597. FIG. 8F shows normalized AUC for IgG anti-S (Y axis) for all males (n=83) and females (n=66) in the cohort; p=0.0275. FIG. 8E shows normalized AUC for IgM anti-S (Y axis) for all males (n=83) and females (n=66) in the cohort; p=0.5363. FIG. 8H shows normalized AUC for IgM anti-RBD (Y axis) for all outpatient (=138) and hospitalized (n=11) participants in the cohort; p=0.0059. FIG. 8I shows normalized AUC for IgG anti-S (Y axis) for all outpatient (=138) and hospitalized (=11) participants in the cohort; p=0.0623. FIG. 8J shows normalized AUC for IgM anti-S (Y axis) for all outpatient (=138) and hospitalized (=11) participants in the cohort; p=0.2976. Horizontal bars indicate median values. Statistical significance was determined using two-tailed Mann-Whitney U test.

FIGS. 9A, 9B, 9C, 9D, 9E, 9F, 9G, 9H, 9I, 9J, 9K, 9L, 9M, and 9N (collectively "FIG. 9") are a set of graphs showing additional clinical correlates of plasma antibody titers. FIG. 9A shows time between symptom onset and plasma collection in days (X axis) plotted against normalized AUC for IgG anti-RBD (Y axis); r=−0.0261 p=0.7533. FIG. 9B shows time between symptom onset and plasma collection in days (X axis) plotted against normalized AUC for IgG anti-S(Y axis); r=−0.1495 p=0.0697. FIG. 9C shows time between symptom onset and plasma collection in days (X axis) plotted against normalized AUC for IgM anti-S (Y axis); r=0.1496 p=0.0695. FIG. 9D shows age (X axis) plotted against AUC for IgM anti-RBD (Y axis); r=0.0172 p=0.8355. FIG. 9E shows age (X axis) plotted against normalized AUC for IgG anti-S (Y axis); r=0.1523 p=0.0638. FIG. 9F shows age (X axis) plotted against normalized AUC for IgM anti-S (Y axis); r=0.0565 p=0.4934. FIG. 9G shows duration of symptoms in days (X axis) plotted against normalized AUC for IgG anti-RBD (Y axis); r=0.1525, p=0.0633. FIG. 9H shows duration of symptoms in days (X axis) plotted against normalized AUC for IgM anti-RBD (Y axis); r=−0.3187, p=<0.0001. FIG. 9I shows duration of symptoms in days (X axis) plotted against normalized AUC for IgG anti-S (Y axis); r=0.0329, p=0.6904. FIG. 9J shows duration of symptoms in days (X axis) plotted against normalized AUC for IgM anti-S (Y axis); r=0.0824, p=0.3177. FIG. 9K shows severity of symptoms (X axis) plotted against normalized AUC for IgG anti-RBD (Y axis); r=0.2679 p=0.0010. FIG. 9L shows severity of symptoms (X axis) plotted against normalized AUC for IgM anti-RBD (Y axis); r=−0.1943 p=0.0176. FIG. 9M shows severity of symptoms (X axis) plotted against normalized AUC for IgG anti-S (Y axis); r=0.1187 p=0.1492. FIG. 9N shows severity of symptoms (X axis) plotted against normalized AUC for IgM anti-S (Y axis); r=0.1597 p=0.0517. All correlations were analyzed by two-tailed Spearman's.

FIGS. 10A, 10B, and 10C (collectively "FIG. 10") show a diagrammatic representation of the SARS-CoV2-Strunc luciferase assay. FIG. 10A shows that co-transfection of pNL4-3ΔEnv-nanoluc and pSARS-CoV-2 spike vectors into 293T cells (ATCC) leads to production of SARS-CoV-2 Spike-pseudotyped HIV-1 particles (SARS-CoV-2 pseudovirus) carrying the Nanoluc gene. FIG. 10B shows that SARS-CoV-2 pseudovirus was incubated for 1 h at 37° C. with plasma or monoclonal antibody dilutions. The virus-antibody mixture is used to infect ACE2-expressing 293T cells, which will express nanoluc Luciferase upon infection. FIG. 10C shows relative luminescence units (RLU) reads from lysates of ACE2-expressing 293T cells infected with increasing amounts of SARS-CoV-2 pseudovirus. Error bars represent standard deviation of triplicates, two experiments.

FIGS. 11A, 11B, 11C, 11D, 11E, and 11F (collectively "FIG. 11") are a set of graphs showing clinical correlates of neutralization. FIG. 11A shows normalized AUC for anti-RBD IgM (X axis) plotted against $NT_{50}$ (Y axis); r=0.3119, p=0.0001. FIG. 11B shows normalized AUC for anti-S IgM (X axis) plotted against $NT_{50}$ (Y axis); r=0.3211, p=<0.0001. FIG. 11C shows duration of symptoms in days (X axis) plotted against $NT_{50}$ (Y axis); r=0.1997, p=0.0146. FIG. 11D shows time between symptom onset and plasma collection in days (X axis) plotted against $NT_{50}$ (Y axis); r=−0.1344, p=0.1033. FIG. 11E shows symptom severity (X axis) plotted against $NT_{50}$ (Y axis); r=0.2234, p=0.0062. FIG. 11F shows age (X axis) plotted against $NT_{50}$ (Y axis); r=0.3005, p=0.0002. All correlations were analyzed by two-tailed Spearman's. Dotted line ($NT_{50}$=5) represents lower limit of detection (LLOD) of pseudovirus neutralization assay. Samples with neutralizing titers below 1:50 were plotted at LLOD.

FIG. 14A shows that for each individual, the number of somatic nucleotide mutations (Y axis) at the IGVH and IGVL are shown on the left panel, and the amino acid length of the CDR3s (Y axis) are shown on the right panel. The horizontal bars indicate the mean. The number of antibody sequences (IGVH and IGVL) evaluated in each participant are n=118 (COV107), n=127 (COV21), n=79 (COV47), n=54 (COV57), n=78 (COV72), n=78 (COV96). FIG. 14B is the same as in FIG. 14A but for all antibodies combined (n=534 for both IGVH and IGVL). FIG. 14C shows distribution of the hydrophobicity GRAVY scores at the IGH CDR3 in antibody sequences from this study compared to a public database (see Methods for statistical analysis in EXAMPLE 1). The box limits are at the lower and upper quartiles, the center line indicates the median, the whiskers are 1.5× interquartile range, and the dots represent outliers.

FIG. 15A shows $EC_{30}$ values for binding to the RBD of SARS-CoV-2. Average of two or more experiments; n=89. FIGS. 15B and 15C show binding curves and $EC_{30}$ values (average of two experiments) for binding to the RBD of SARS-CoV; n=20 and n=17 (excluding isotype and CR3022), respectively. FIGS. 15D and 15E show SARS-CoV pseudovirus neutralization curves and $IC_{50}$ values. Shown in FIG. 15D are the standard deviations of duplicates for one representative experiment and in FIG. 15E is the average of two experiments (n=10, excluding CR3022). Samples with $IC_{50}$s above 1 μg/ml were plotted at 1 μg/ml.

FIGS. 17A, 17B, and 17C (collectively "FIG. 17") are a set of diagrams depicting that coronavirus S proteins show localized regions of conservation and variability. FIG. 17A is a schematic of SARS-CoV-2 S protein domain architecture. The S1 and S2 subunits are indicated, with scissors representing the locations of proteolytic cleavage sites required for S priming prior to fusion. UH=upstream helix, FP=fusion peptide, HR1=heptad repeat 1, CH=central helix, BH=β-hairpin, HR2=heptad repeat 2, TM=transmembrane region, CT=cytoplasmic tail. FIG. 17B shows phylogenetic trees of selected coronaviruses based on protein sequences of S proteins and RBD/S1B domains. FIG. 17C shows sequence conservation of 7 human coronaviruses plotted as a surface. The sequence alignment was generated using SARS-CoV-2 (GenBank MN985325.1), SARS-CoV (AAP13441.1), MERS-CoV (JX869059.2), HCoV-OC43 (AAT84362.1), HCoV-229E (AAK32191.1), HCoV-NL63 (AAS58177.1), and HCoV-HKU1 (QOZME7.1). Conservation was calculated by ConSurf Database (Landau et al., 2005) and displayed using a surface representation of the structure of the SARS-CoV-2 S protein (PDB code 6VXX).

FIGS. 18A, 18B, and 18C (collectively "FIG. 18") are a set of diagrams showing that plasma Fabs bind to SARS-CoV-2 S protein. FIG. 18A shows a schematic of polyclonal IgG and Fab purification from human plasma for nsEMPEM protocol. FIG. 18B shows an SEC profile of Fabs (left) and SDS-PAGE of purified IgGs and Fabs (right) from COV21, COV57, and COV107 plasma samples. FIG. 18C shows SEC demonstration that plasma-derived Fabs from COV21 and COV57 shift the SARS-CoV-2 S protein trimer to a higher apparent molecular weight. No shift was observed when Fabs from COV107 were analyzed by SEC with S protein. Fractions pooled and concentrated for nsEMPEM are boxed. See also FIG. 24.

FIGS. 19A, 19B, 19C, 19D, 19E, 19F, 19G, and 19H (collectively "FIG. 19") show convalescent plasma IgG and Fab binding properties demonstrating recognition of diverse coronaviruses and effects of avidity. Results from ELISAs assessing binding of IgGs and Fabs purified from plasmas from 10 COVID-19 individuals (X-axis) presented as area under the curve (AUC; shown as mean±S.D. of values derived from experiments conducted in triplicate). FIGS. 19A, 19B, 19C, 19D, 19E, and 19F show that binding was assessed against S and RBD proteins for SARS-CoV-2 (FIG. 19A), SARS-CoV (FIG. 19B), MERS-CoV (FIG. 19C), HCoV-NL63 (FIG. 19D), HCoV-OC43 (FIG. 19E), and HCoV-229E (FIG. 19F). Polyclonal IgGs or Fabs were evaluated at a top concentration of 50 µg/mL and 7 additional 4-fold serial dilutions. Binding of the IgG and Fab from IOMA, an antibody against HIV-1 (Gristick et al., 2016), was used as a control in each assay. FIG. 19G shows in vitro neutralization assays comparing the potencies of purified plasma IgGs and purified plasma Fabs. COV21, COV57, and COV107 plasma Fabs and IgGs are highlighted in the indicated colors; curves for 10 other plasmas (listed in FIG. 19H) are gray. FIG. 19H shows molar $IC_{50}$ values for purified plasma IgGs and Fabs for the indicated plasmas are listed with the molar ratio for $IC_{50}$ (Fab) to $IC_{50}$ (IgG) shown in the right column. See also FIGS. 25 and 26.

FIGS. 20A, 20B, and 20C (collectively "FIG. 20") show the results of the EM study that reveals distinct predominant epitopes targeted by convalescent plasma antibodies. FIG. 20A shows side and top views for representative 3D reconstructions of four nsEMPEM datasets (S protein alone, S+COV21 Fabs, S+COV57 Fabs, S+COV107 Fabs). Bound Fabs observed in reconstructions from COV21 and COV57 plasmas are highlighted with false coloring as orange and green, respectively. No Fabs were observed in the reconstruction of COV107 Fabs plus S protein. Refined 3D models for SARS-CoV-2 S trimer-polyclonal Fab complexes from COV21 (panel B), and COV57 (panel C) were rigid-body fit with reference structures in Chimera (Goddard et al., 2007; Pettersen et al., 2004), displayed as cartoons ($S1^A$: blue, $S1^B$: red, S2: gray). FIG. 20B shows that for COV21, the volume was best-fitted with PDB 6VYB (SARS-CoV-2, one "up" $S1^B$ conformation, inset). Overlay of PDB 6NB6 showed similarities in $S1^B$ epitope targeting of COV21 Fab (orange) and the human SARS-CoV neutralizing antibody, S230 (magenta, cartoon). FIG. 20C shows that COV57 was fitted with PDB 6VXX (closed, prefusion conformation, inset). Fab density (green) was focused on the $S1^A$ domain. See also FIG. 27.

FIGS. 21A, 21B, 21C, 21D, 21E, and 21F (collectively "FIG. 21") show a cryo-EM structure of a monoclonal Fab-S protein complex that resembles the COV21 Fab(s)-S reconstruction. FIG. 21A shows reconstructed volumes for mAb C105 bound to SARS-CoV-2 S trimers in state 1 (two "up" RBDs, two bound Fabs) and state 2 (three "up" RBDs, three bound Fabs). FIG. 21B shows cartoon representation of VH-VL domains of C105 bound to an RBD (left panel) and CDR loops of C105 overlaid on surface representation of the RBD (shown as a gray surface) (right panel). FIG. 21C shows RBD surface showing contacts by C105 VH-VL (contacts defined as an RBD residue within 7 Å of a VH or VL residue Cα atom). FIG. 21D shows RBD surface fitted with volume representing the variable domains of the COV21 Fab(s) nsEMPEM reconstruction. FIG. 21E shows CDR loops of B38 mAb overlaid on surface representation of the RBD (from PDB code 7BZ5). FIG. 21F shows RBD surface showing contacts by ACE2 (contacts defined as an RBD residue within 7 Å of an ACE2 residue Cα atom) (from PDB code 6VW1). See also FIGS. 29 and 30.

FIGS. 22A, 22B, and 22C (collectively "FIG. 22") show identified S mutations that are unlikely to affect epitopes revealed by nsEMPEM and single-particle cryo-EM. FIGS. 22A and 22B show the refined 3D model of SARS-CoV-2 S trimer alone that was fitted with a reference structure (PDB 6VYB; gray cartoon) with locations of mutations observed in circulating SARS-CoV-2 isolates (Table 17) highlighted (red spheres). Residues affected by mutations that are disordered in the SARS-CoV-2 S structure (V483A) or in regions that are not included in the S ectodomain (signal sequence or cytoplasmic tail) are not shown. Densities corresponding to Fabs were separated, colored, and displayed on the same 3D volume. FIG. 22C shows C105-RBD interaction from the cryo-EM structure of the C105-S complex (FIG. 21), showing locations of RBD mutations. V483 is ordered in this structure. See also Table 17.

FIGS. 23A, 23B, and 23C (collectively "FIG. 23") show S protein epitopes that offer different possibilities for avidity effects during IgG and receptor binding. FIG. 23A, left panel, shows a model of two adjacent S trimers separated by ~15 nm, as seen on coronaviruses by cryo-electron tomography (Neuman et al., 2011), demonstrating that the orientation of COV21 Fab(s) on S could accommodate inter-spike crosslinking by a single IgG. The Fc portion of the IgG (PDB code 1IGT) was modeled assuming flexibility between the Fabs and the Fc (Sandin et al., 2004) and with the hinge region indicated by a dotted line since it is disordered in crystal structures of intact IgGs (Harris et al., 1992; Harris et al., 1998; Saphire et al., 2001). FIG. 23A, right panel, shows an example of a model of two adjacent S trimers with bound Fab(s) in the orientation observed in the COV57 Fab(s)-S reconstruction demonstrating that inter-spike crosslinking is unlikely due to the "downward" orientation of the Fab(s), which does not permit linking by an Fc region, and predicted steric clashes between adjacent Fabs. Inter-spike crosslinking is also not possible for other orientations of two adjacent COV57 Fab(s)-S complexes (not shown). FIG. 23B show a model of S trimers with two RBDs in an "up" position based on a cryo-EM structure of SARS-CoV S trimer (Kirchdoerfer et al., 2018) (PDB code 6CRX) interacting with full-length ACE2 receptors from the cryo-EM structure of soluble SARS-CoV-2 RBDs bound to the dimeric membrane form of ACE2 (Yan et al., 2020) (PDB code 6M17). Inter-spike crosslinking is possible if ACE2 dimers cluster in the membrane. FIG. 23C shows a model of intra-spike crosslinking between dimeric ACE2 and an S protein trimer with two RBDs in an "up" position. The RBDs were rotated by ~180 about their long axes to allow binding of the ACE2 ectodomains. Rotation of the RBD is a possibility since its position is flexible with respect to the remaining part of the S trimer (Walls et al., 2019). In this model, RBDs from a single S trimer could bind the ACE2 dimer in the same configuration as seen in the B°AT1-ACE2-SARS-CoV-2 RBD structure (PDB code 6M17).

FIGS. 24A, 24B, 24C, 24D, 24E, 24F, 24G, 24H, 24I, 24J, 24K, and 24L (collectively "FIG. 24") show SEC-MALS characterization of purified proteins (related to FIGS. 18 and 19). FIGS. 24A, 24B, 24C, 24G, 24H, 24I show the SEC-MALS results of CoV S trimers, and FIGS. 24D, 24E, 24F, 24J, 24K, and 24L show corresponding representative nsEM. Scale bar on micrographs represents 50 nm.

FIGS. 25A, 25B, 25C, 25D, 25E, and 25F (collectively "FIG. 25") show SARS-CoV-2, SARS-CoV, MERS-CoV and common cold coronavirus ELISA curves (related to FIG. 19). Anti-S IgG (left panel), Anti-S Fab (middle left panel), Anti-RBD/S1$^B$ IgG (middle right panel), and Anti-RBD/S1$^B$ Fab (right panel) ELISA binding data for (FIG. 25A) SARS-CoV-2, (FIG. 25B) SARS-CoV, (FIG. 25C) MERS-CoV, (FIG. 25D) HCoV-NL63, (FIG. 25E) HCoV-OC43, and (FIG. 25F) HCoV-229E. COV21: red curves; COV57: green curves; COV107: magenta curves. Curves for other plasmas are in gray. Each curve represents the average of three independent experiments. Binding of the IgG and Fab from IOMA, an antibody against HIV-1 (Gristick et al., 2016), was used as a control in each assay.

FIGS. 26A, 26B, 26C, 26D, 26E, and 26F (collectively "FIG. 26") show RBD adsorption experiments to assess degrees of cross-reactive RBD recognition by plasma IgGs (related to FIG. 19). Purified IgGs from COVID-19 plasmas (indicated by numbers) and control plasmas (indicated as "con") were adsorbed with one of two resins: a SARS-CoV-2 RBD resin (IgGs remaining after RBD adsorption; light gray bars) and a 2G12 mAb control resin (IgGs remaining after control adsorption; dark gray bars). IgGs remaining after adsorption were evaluated in ELISAs against the indicated RBD (or S1$^B$) domains. Binding of IgGs after adsorption to IOMA, an antibody against HIV-1 (Gristick et al., 2016), was used as a control in each assay. Results are presented as area under the curve (AUC; shown as mean of experiments conducted in duplicate).

FIGS. 27A, 27B, 27C, 27D, 27E, and 27F (collectively "FIG. 27") show representative 2D class-averages and 3D models from nsEMPEM of human convalescent plasma (related to FIG. 20). FIGS. 27A, 27C, and 27E show representative reference-free 2D class-averages obtained from EM data collections of (FIG. 27A) SARS-CoV-2 S trimers alone, (FIG. 27C) SARS-CoV-2 S complexed with COV21 polyclonal Fabs, and (FIG. 27E) SARS-CoV-2 S complexed with COV57 polyclonal Fabs. For COV21 and COV57, class-averages demonstrating extra density beyond the S trimer core are highlighted (red boxes). For COV107, no extra density was observed in class averages or a 3D construction. FIGS. 27B, 27D, and 27F show refined 3D models after iterative rounds of 2D and 3D classification. Features corresponding to Fabs are denoted.

FIGS. 28A, 28B, and 28C (collectively "FIG. 28") show data collection and processing pipeline for the cryo-EM structure of the C105-SARS-CoV-2 S complex (related to FIG. 21). FIG. 28A shows a representative micrograph of C105-S complex in vitreous ice. Power spectrum of micrograph determined during CTF estimation showing Thon rings to 3.2 Å is shown in the inset. FIG. 28B shows reference-free 2D classification of extracted particles. FIG. 28C shows workflow for classification and refinement of selected particles. Briefly, after selection of good 2D class averages, an ab initio model was generated, which was then homogeneously refined before further 3D classification. To improve features at the SARS-CoV-2 RBD-C105 Fab interface, particles from states 1 and 2 were combined and used for nonuniform, focused refinement to yield a state 1-like reconstruction to an FSC=0.143 resolution of 3.4 Å.

FIGS. 29A, 29B, 29C, 29D, and 29E (collectively "FIG. 29") show cryo-EM structure validation (related to FIG. 21). FIG. 29A shows fourier shell correlation (FSC) plots calculated from half-maps of state 1 (black), state 1 after focused refinement (blue) and state 2 (red). Dotted lines for FSC values of 0.5 and 0.143 are shown. FIGS. 29B and 29C show 2D angular distribution plot for state 1 (FIG. 29B) and state 2 (FIG. 29C) reconstructions. FIG. 29D shows local resolution estimations for states 1 and 2 and at the RBD-C105 Fab interface. FIG. 29E shows representative density from S trimer and Fab regions of the state 1 reconstructed volume. Maps are contoured at 6σ.

FIG. 30A shows the CDRH3 lengths (IMGT definition) (Lefranc et al., 2015) of anti-SARS-CoV-2 RBD-binding mAbs (Robbiani et al., 2020) are shown in three groups: all 534 mAbs (dark gray), those derived from VH3-53 (red), and those derived from VH3-66 (green). For comparison, the CDRH3 length distribution from the human antibody repertoire (Briney et al., 2019) is also shown (normalized to the same total count as the set of 534). The CDRH3 length of mAb B38 is indicated with an arrow. FIG. 30B shows the length of CDRH3s in human antibodies versus predicted clashes with SARS-CoV-2 RBD if binding in the orientation observed for the mAbs B38 and C105. The VH domains of 1364 human antibody structures with resolutions of ≤3.5 Å downloaded from SAbDab (Dunbar et al., 2014) were aligned to the B38 VH domain in complex with SARS-CoV-2 RBD (PDB code 7BZ5) (Wu et al., 2020c). In cases in which there was more than one Fab in the crystallographic asymmetric unit, each VH was evaluated and enumerated separately. CDRH3 clashes were defined if any CDRH3 atom was within 2.0 Å of an atom in the RBD, a stringent criterion devised to account for not allowing CDR flexibility or different side chain rotamer conformations.

FIGS. 31A and 31B show the titration curves (FIG. 31A) and IC50 and IC90 values (FIG. 31B) of C135 and C144' from different lots (also see Table 14 for the sequences). FIG. 31C shows the titration curves of C135, C144', and C135 combined with C144' from the GMP lots, with the IC50 and IC90 values summarized in FIG. 31D.

DETAILED DESCRIPTION OF THE INVENTION

Figure 1A:
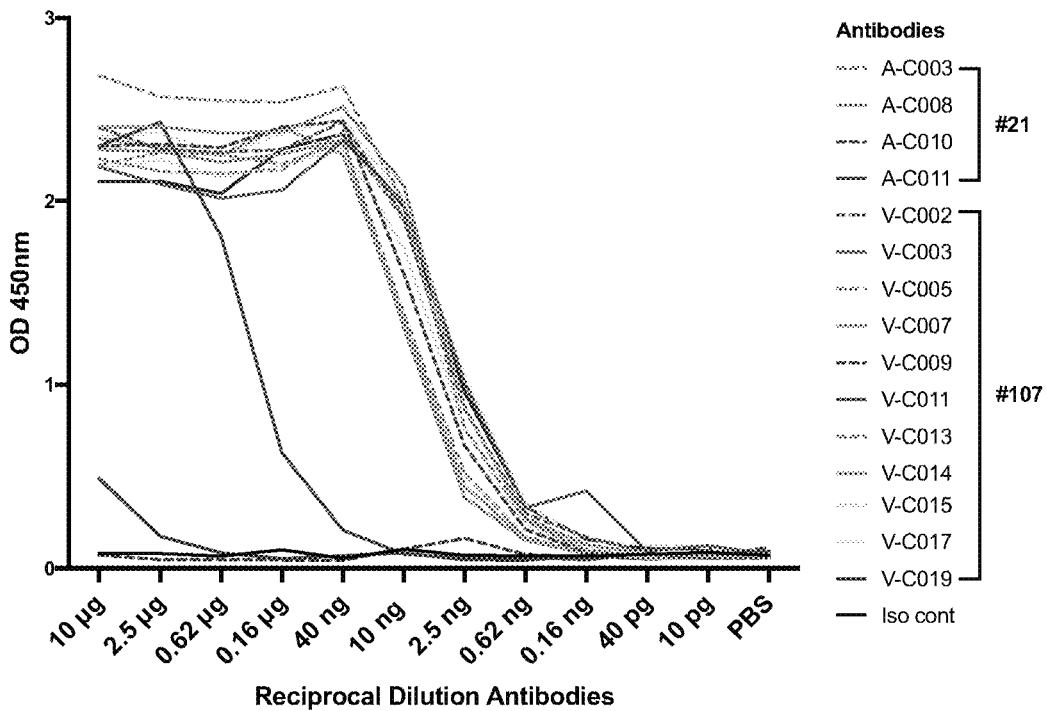
FIGS. 1A and 1B are a set of graphs showing the results of monoclonal antibodies for neutralization of SARS-CoV-2 pseudovirus expressing nanoluciferase.

SARS-CoV-2 represents a serious public health concern. Methods to diagnose and treat persons who are infected with SARS-CoV-2 provide the opportunity to either prevent or control further spread of infection by SARS-CoV-2. These methods are especially important due to the ability of SARS-CoV-2 to infect persons through an airborne route.

This invention is based, at least in part, on unexpected broadly neutralizing activities of the disclosed anti-SARS-CoV-2 antibodies or antigen-binding fragments thereof. These antibodies and antigen-binding fragments constitute a novel therapeutic strategy in protection from SARS-CoV-2 infections.

A. BROADLY NEUTRALIZING ANTI-SARS-COV-2 ANTIBODIES a. Antibodies

The invention disclosed herein involves broadly neutralizing anti-SARS-CoV-2 antibodies or antigen-binding fragments thereof. These antibodies refer to a class of neutralizing antibodies that neutralize multiple SARS-CoV-2 virus strains. The antibodies are able to protect a subject prophylactically and therapeutically against a lethal challenge with a SARS-CoV-2 virus.

In one aspect, this disclosure provides an isolated anti-SARS-CoV-2 antibody or antigen-binding fragment thereof that binds specifically to a SARS-CoV-2 antigen. In some embodiments, the SARS-CoV-2 antigen comprises a portion of a Spike (S) polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide. In some embodiments, the antibody or antigen-binding fragment thereof is capable of neutralizing a plurality of SARS-CoV-2 strains.

In some embodiments, the antibody or antigen-binding fragment thereof is capable of neutralizing a SARS-CoV-2 virus at an IC50 concentration of less than 50 μg/ml.

The spike protein is important because it is present on the outside of intact SARS-CoV-2. Thus, it presents a target that can be used to inhibit or eliminate an intact virus before the virus has an opportunity to infect a cell. A representative amino acid sequence is provided below:

```
(Accession ID: NC_045512.2; SEQ ID NO: 2927)
MFVFLVLLPLVSSQCVNLTTRTQLPPAYTNSFTRGVYYPDKVFRSSVLHS

TQDLFLPFFSNVTWFHAIHVSGTNGTKRFDNPVLPFNDGVYFASTEKSNI

IRGWIFGTTLDSKTQSLLIVNNATNVVIKVCEFQFCNDPFLGVYYHKNNK

SWMESEFRVYSSANNCTFEYVSQPFLMDLEGKQGNFKNLREFVFKNIDGY

FKIYSKHTPINLVRDLPQGFSALEPLVDLPIGINITRFQTLLALHRSYLT
```

```
-continued

PGDSSSGWTAGAAAYYVGYLQPRTFLLKYNENGTITDAVDCALDPLSETK

CTLKSFTVEKGIYQTSNFRVQPTESIVRFPNITNLCPFGEVFNATRFASV

YAWNRKRISNCVADYSVLYNSASFSTFKCYGVSPTKLNDLCFTNVYADSF

VIRGDEVRQIAPGQTGKIADYNYKLPDDFTGCVIAWNSNNLDSKVGGNYN

YLYRLFRKSNLKPFERDISTEIYQAGSTPCNGVEGFNCYFPLQSYGFQPT

NGVGYQPYRVVVLSFELLHAPATVCGPKKSTNLVKNKCVNFNFNGLTGTG

VLTESNKKFLPFQQFGRDIADTTDAVRDPQTLEILDITPCSFGGVSVITP

GTNTSNQVAVLYQDVNCTEVPVAIHADQLTPTWRVYSTGSNVFQTRAGCL

IGAEHVNNSYECDIPIGAGICASYQTQTNSPRRARSVASQSIIAYTMSLG

AENSVAYSNNSIAIPTNFTISVTTEILPVSMTKTSVDCTMYICGDSTECS

NLLLQYGSFCTQLNRALTGIAVEQDKNTQEVFAQVKQIYKTPPIKDFGGF

NFSQILPDPSKPSKRSFIEDLLFNKVTLADAGFIKQYGDCLGDIAARDLI

CAQKFNGLTVLPPLLTDEMIAQYTSALLAGTITSGWTFGAGAALQIPFAM

QMAYRFNGIGVTQNVLYENQKLIANQFNSAIGKIQDSLSSTASALGKLQD

VVNQNAQALNTLVKQLSSNFGAISSVLNDILSRLDKVEAEVQIDRLITGR

LQSLQTYVTQQLIRAAEIRASANLAATKMSECVLGQSKRVDFCGKGYHLM

SFPQSAPHGVVFLHVTYVPAQEKNFTTAPAICHDGKAHFPREGVFVSNGT

HWFVTQRNFYEPQIITTDNTFVSGNCDVVIGIVNNTVYDPLQPELDSFKE

ELDKYFKNHTSPDVDLGDISGINASVVNIQKEIDRLNEVAKNLNESLIDL

QELGKYEQYIKWPWYIWLGFIAGLIAIVMVTIMLCCMTSCCSCLKGCCSC

GSCCKFDEDDSEPVLKGVKLHYT
```

Listed below in TABLES 4-5 and 7-14 are amino acid sequences of the heavy chain (HC) variable regions and light chain (LC) variable regions of exemplary antibodies.

In some embodiments, the antibody or antigen-binding fragment thereof comprises three heavy chain complementarity determining regions (HCDRs) (HCDR1, HCDR2, and HCDR3) of a heavy chain variable region having an amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and three light chain CDRs (LCDR1, LCDR2, and LCDR3) of a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

HCDR1, HCDR2, HCDR3, LCDR1, LCDR2, and LCDR3 comprising respective amino acid sequences of (i) SEQ ID NOs: 2878, 2880, 2882, 2890, 2892, and 2894; or (ii) SEQ ID NOs: 2902, 2904, 2906, 2914, 2916, and 2918.

In some embodiments, the antibody or antigen-binding fragment thereof comprises: (i) a heavy chain variable region having an amino acid sequence with at least 75% identity to SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; or (ii) a light chain variable region having an amino acid sequence with at least 75% identity to SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having an amino acid sequence with at least 75% identity to SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and (ii) a light chain variable region having an amino acid sequence with at least 75% identity to SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having the amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; or (ii) a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises: (i) a heavy chain variable region having the amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 2876, or 2900; and (ii) a light chain variable region having the amino acid sequence of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 2888, or 2912.

In some embodiments, the antibody or antigen-binding fragment thereof comprises a heavy chain variable region and a light chain variable region comprise the respective amino acid sequences of SEQ ID NOs: 1-2, 3-4, 5-6, 7-8, 9-10, 11-12, 13-14, 15-16, 17-18, 19-20, 21-22, 23-24, 25-26, 27-28, 29-30, 31-32, 33-34, 35-36, 37-38, 39-40, 41-42, 43-44, 45-46, 47-48, 49-50, 51-52, 53-54, 55-56, 57-58, 59-60, 61-62, 63-64, 65-66, 67-68, 69-70, 71-72, 73-74, 75-76, 77-78, 79-80, 81-82, 83-84, 85-86, 87-88, 89-90, 91-92, 93-94, 95-96, 97-98, 99-100, 101-102, 103-104, 105-106, 107-108, 109-110, 111-112, 113-114, 115-116, 117-118, 119-120, 121-122, 123-124, 125-126, 127-128, 129-130, 131-132, 133-134, 135-136, 137-138, 139-140, 141-142, 143-144, 145-146, 147-148, 149-150, 151-152, 153-154, 155-156, 157-158, 159-160, 161-162, 163-164, 165-166, 167-168, 169-170, 171-172, 173-174, 175-176, 177-178, 179-180, 181-182, 183-184, 185-186, 187-188, 2876 and 2888, or 2900 and 2912.

In some embodiments, the antibody or antigen-binding fragment thereof comprises a heavy chain and a light chain that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the antibody or antigen-binding fragment thereof comprises a heavy chain/light chain sequence pair of SEQ ID NOs: 2886/2898, 2887/2899, 2910/2921, or 2911/2922.

In some embodiments, the antibody or antigen-binding fragment thereof comprises (a) a first target binding site that specifically binds to an epitope within the S polypeptide, and (b) a second target binding site that binds to a different epitope on the S polypeptide or on a different molecule. In some embodiments, the multivalent antibody is a bivalent or bispecific antibody.

In some embodiments, the antibody or the antigen-binding fragment thereof further comprises a variant Fc constant region. In some embodiments, the antibody is a monoclonal antibody. In some embodiments, the antibody is a chimeric antibody, a humanized antibody, or a humanized monoclonal antibody. In some embodiments, the antibody is a single-chain antibody, Fab or Fab2 fragment.

In some embodiments, the antibody or the antigen-binding fragment thereof further comprises a variant Fc constant region. The antibody can be a monoclonal antibody. In some embodiments, the antibody can be a chimeric antibody, a humanized antibody, or humanized monoclonal antibody. In some embodiments, the antibody can be a single-chain antibody, Fab or Fab2 fragment.

In some embodiments, the antibody or antigen-binding fragment thereof can be detectably labeled or conjugated to a toxin, a therapeutic agent, a polymer (e.g., polyethylene glycol (PEG)), a receptor, an enzyme or a receptor ligand. For example, an antibody of the present invention may be coupled to a toxin (e.g., a tetanus toxin). Such antibodies may be used to treat animals, including humans, that are infected with the virus that is etiologically linked to SARS- CoV-2. The toxin-coupled antibody is thought to bind to a portion of a spike protein presented on an infected cell, and then kill the infected cell.

In another example, an antibody of the present invention may be coupled to a detectable tag. Such antibodies may be used within diagnostic assays to determine if an animal, such as a human, is infected with SARS-CoV-2. Examples of detectable tags include: fluorescent proteins (i.e., green fluorescent protein, red fluorescent protein, yellow fluorescent protein), fluorescent markers (i.e., fluorescein isothiocyanate, rhodamine, texas red), radiolabels (i.e., 3H, 32P, 125I), enzymes (i.e., β-galactosidase, horseradish peroxidase, β-glucuronidase, alkaline phosphatase), or an affinity tag (i.e., avidin, biotin, streptavidin). Methods to couple antibodies to a detectable tag are known in the art. Harlow et al., Antibodies: A Laboratory Manual, page 319 (Cold Spring Harbor Pub. 1988).

b. Fragment

In some embodiments, an antibody provided herein is an antibody fragment. Antibody fragments include, but are not limited to, Fab, Fab', Fab'-SH, F(ab')2, Fv, and single-chain Fv (scFv) fragments, and other fragments described below, e.g., diabodies, triabodies tetrabodies, and single-domain antibodies. For a review of certain antibody fragments, see Hudson et al., Nat. Med. 9:129-134 (2003). For a review of scFv fragments, see, e.g., Pluckthun, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., Nat. Med. 9:129-134 (2003); and Hollinger et al., Proc. Natl. Acad. Sci. USA 90: 6444-6448 (1993). Triabodies and tetrabodies are also described in Hudson et al., Nat. Med. 9:129-134 (2003).

Single-domain antibodies are antibody fragments comprising all or a portion of the heavy chain variable domain or all or a portion of the light chain variable domain of an antibody. In some embodiments, a single-domain antibody is a human single-domain antibody (DOMANTIS, Inc., Waltham, Mass.; see, e.g., U.S. Pat. No. 6,248,516).

Antibody fragments can be made by various techniques, including but not limited to proteolytic digestion of an intact antibody as well as production by recombinant host cells (e.g., *E. coli* or phage), as described herein.

c. Chimeric and Humanized Antibodies

In some embodiments, an antibody provided herein is a chimeric antibody. Certain chimeric antibodies are described, e.g., in U.S. Pat. No. 4,816,567; and Morrison et al., Proc. Natl. Acad. Sci. USA, 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In some embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing specificity determining region (SDR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005) and Klimka et al., Br. J. Cancer, 83:252-260 (2000) (describing the "guided selection" approach to FR shuffling).

Human framework regions that may be used for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151:2623 (1993)); human mature (somatically mutated) framework regions or human germline framework regions (see, e.g., Almagro and Fransson, Front. Biosci. 13:1619-1633 (2008)); and framework regions derived from screening FR libraries (see, e.g., Baca et al., J. Biol. Chem. 272:10678-10684 (1997) and Rosok et al., J. Biol. Chem. 271:22611-22618 (1996)).

d. Human Antibodies

In some embodiments, an antibody provided herein is a human antibody. Human antibodies can be produced using various techniques known in the art or using techniques described herein. Human antibodies are described generally in van Dijk and van de Winkel, Curr. Opin. Pharmacol. 5: 368-74 (2001) and Lonberg, Curr. Opin. Immunol. 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, Nat. Biotech. 23:1117-1125 (2005). See also, e.g., U.S. Pat. Nos. 6,075,181 and 6,150,584 describing XENO-MOUSE technology; U.S. Pat. No. 5,770,429 describing HUMAB technology; U.S. Pat. No. 7,041,870 describing K-M MOUSE technology, and U.S. Patent Application Publication No. US 2007/0061900, describing VELOCI-MOUSE technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991).) Human antibodies generated via human B-cell hybridoma technology are also described in Li et al., Proc. Natl. Acad. Sci. USA, 103:3557-3562 (2006). Additional methods include those described, for example, in U.S. Pat. No. 7,189,826 (describing production of monoclonal human IgM antibodies from hybridoma cell lines) and Ni, Xiandai Mianyixue, 26(4):265-268 (2006) (describing human-human hybridomas). Human hybridoma technology (Trioma technology) is also described in Vollmers and Brandlein, Histology and Histopathology, 20(3):927-937 (2005) and Vollmers and Brandlein, Methods and Findings in Experimental and Clinical Pharmacology, 27(3):185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

Antibodies of the invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al., in Methods in Molecular Biology 178: 1-37 (O'Brien et al., ed., Human Press, Totowa, N.J., 2001) and further described, e.g., in the McCafferty et al., Nature 348:552-554; Clackson et al., Nature 352: 624-628 (1991); Marks et al., J. Mol. Biol. 222: 581-597 (1992); Marks and Bradbury, in Methods in Molecular Biology 248:161-175 (Lo, ed., Human Press, Totowa, N.J., 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., Ann. Rev. Immunol., 12: 433-455 (1994). Phage typically display antibody fragments, either as scFv fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self-antigens without any immunization as described by Griffiths et al., EMBO J, 12: 725-734 (1993). Finally, naive libraries can also be made synthetically by cloning unrearranged V-gene segments from stem cells and using PCR primers containing random sequence to encode the highly variable CDR3 regions and to accomplish rearrangement in vitro, as described by Hoogenboom and Winter, J. Mol. Biol., 227: 381-388 (1992). Patent publications describing human antibody phage libraries include, for example, U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360. Antibodies or antibody fragments isolated from human antibody libraries are considered human antibodies or human antibody fragments herein.

e. Variants

In some embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen binding.

Substitution, Insertion, and Deletion Variants

In some embodiments, antibody variants having one or more amino acid substitutions are provided. Sites of interest for substitutional mutagenesis include the HVRs and FRs. Conservative substitutions are defined herein. Amino acid substitutions may be introduced into an antibody of interest and the products screened for a desired activity, e.g., retained/improved antigen binding, decreased immunogenicity, or improved antibody-dependent cell-mediated cytotoxicity (ADCC) and complement-dependent cytotoxicity (CDC).

Accordingly, an antibody of the invention can comprise one or more conservative modifications of the CDRs, heavy chain variable region, or light variable regions described herein. A conservative modification or functional equivalent of a peptide, polypeptide, or protein disclosed in this invention refers to a polypeptide derivative of the peptide, polypeptide, or protein, e.g., a protein having one or more point mutations, insertions, deletions, truncations, a fusion protein, or a combination thereof. It substantially retains the activity to of the parent peptide, polypeptide, or protein (such as those disclosed in this invention). In general, a conservative modification or functional equivalent is at least 60% (e.g., any number between 60% and 100%, inclusive, e.g., 60%, 70%, 75%, 80%, 85%, 90%, 95%, 96%, 97%, 98%, and 99%) identical to a parent. Accordingly, within the scope of this invention are heavy chain variable region or light variable regions having one or more point mutations, insertions, deletions, truncations, a fusion protein, or a combination thereof, as well as antibodies having the variant regions.

As used herein, the percent homology between two amino acid sequences is equivalent to the percent identity between the two sequences. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (Comput. Appl. Biosci., 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. 48:444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul, et al. (1990) J. Mol. Biol. 215:403-10. BLAST protein searches can be performed with the XBLAST program, score=50, wordlength=3 to obtain amino acid sequences homologous to the antibody molecules of the invention. To obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g., XBLAST and NBLAST) can be used. (See www.ncbi.nlm.nih.gov).

As used herein, the term "conservative modifications" refers to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include: (i) amino acids with basic side chains (e.g., lysine, arginine, histidine), (ii) acidic side chains (e.g., aspartic acid, glutamic acid), (iii) uncharged polar side chains (e.g., glycine, asparagine, glutamine, serine, threonine, tyrosine, cysteine, tryptophan), (iv) nonpolar side chains (e.g., alanine, valine, leucine, isoleucine, proline, phenylalanine, methionine), (v) beta-branched side chains (e.g., threonine, valine, isoleucine), and (vi) aromatic side chains (e.g., tyrosine, phenylalanine, tryptophan, histidine). Non-conservative substitutions will entail exchanging a member of one of these classes for another class.

An exemplary substitutional variant is an affinity matured antibody, which may be conveniently generated, e.g., using phage display-based affinity maturation techniques such as those described in, e.g., Hoogenboom et al., in Methods in Molecular Biology 178:1-37 (O'Brien et al., ed., Human Press, Totowa, N.J., (2001). Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for ADEPT) or a polypeptide which increases the serum half-life of the antibody.

Glycosylation Variants

In some embodiments, an antibody provided herein is altered to increase or decrease the extent to which the antibody is glycosylated. Addition or deletion of glycosylation sites to an antibody may be conveniently accomplished by altering the amino acid sequence such that one or more glycosylation sites are created or removed.

For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Glycosylation of the constant region on N297 may be prevented by mutating the N297 residue to another residue, e.g., N297A, and/or by mutating an adjacent amino acid, e.g., 298 to thereby reduce glycosylation on N297.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies described herein to thereby produce an antibody with altered glycosylation. For example, EP 1,176,195 by Hanai et al. describes a cell line with a functionally disrupted FUT8 gene, which encodes a fucosyltransferase, such that antibodies expressed in such a cell line exhibit hypofucosylation. PCT Publication WO 03/035835 by Presta describes a variant Chinese Hamster Ovary cell line, Lcd 3 cells, with reduced ability to attach fucose to Asn(297)-linked carbohydrates, also resulting in hypofucosylation of antibodies expressed in that host cell (see also Shields, R. L. et al. (2002) J. Biol. Chem. 277:26733-26740). PCT Publication WO 99/54342 by Umana et al. describes cell lines engineered to express glycoprotein-modifying glycosyltransferases (e.g., beta(1,4)-N-acetylglucosaminyltransferase III (GnTIII)) such that antibodies expressed in the engineered cell lines exhibit increased bisecting GlcNac structures which result in increased ADCC activity of the antibodies (see also Umana et al. (1999) Nat. Biotech. 17: 176-180).

Fc Region Variants

The variable regions of the antibody described herein can be linked (e.g., covalently linked or fused) to an Fc, e.g., an IgG1, IgG2, IgG3 or IgG4 Fc, which may be of any allotype or isoallotype, e.g., for IgG1: Glm, Glm1(a), Glm2(x), Glm3(f), Glm17(z); for IgG2: G2m, G2m23(n); for IgG3: G3m, G3m21(g1), G3m28(g5), G3m11(b0), G3m5(b1), G3m13(b3), G3m14(b4), G3m10(b5), G3m15(s), G3m16 (t), G3m6(c3), G3m24(c5), G3m26(u), G3m27(v); and for K: Km, Km1, Km2, Km3 (see, e.g., Jefferies et al. (2009) mAbs 1: 1). In some embodiments, the antibodies variable regions described herein are linked to an Fc that binds to one or more activating Fc receptors (FcγI, FcγIIa or FcγIIIa), and thereby stimulate ADCC and may cause T cell depletion. In some embodiments, the antibody variable regions described herein are linked to an Fc that causes depletion.

In some embodiments, the antibody variable regions described herein may be linked to an Fc comprising one or more modifications, typically to alter one or more functional properties of the antibody, such as serum half-life, complement fixation, Fc receptor binding, and/or antigen-dependent cellular cytotoxicity. Furthermore, an antibody described herein may be chemically modified (e.g., one or more chemical moieties can be attached to the antibody) or be modified to alter its glycosylation, to alter one or more functional properties of the antibody. The numbering of residues in the Fc region is that of the EU index of Kabat.

The Fc region encompasses domains derived from the constant region of an immunoglobulin, preferably a human immunoglobulin, including a fragment, analog, variant, mutant or derivative of the constant region. Suitable immunoglobulins include IgG1, IgG2, IgG3, IgG4, and other classes such as IgA, IgD, IgE and IgM, The constant region of an immunoglobulin is defined as a naturally-occurring or synthetically-produced polypeptide homologous to the immunoglobulin C-terminal region, and can include a CH1 domain, a hinge, a CH2 domain, a CH3 domain, or a CH4 domain, separately or in combination. In some embodiments, an antibody of this invention has an Fc region other than that of a wild type IgA1. The antibody can have an Fc region from that of IgG (e.g., IgG1, IgG2, IgG3, and IgG4) or other classes such as IgA2, IgD, IgE, and IgM. The Fc can be a mutant form of IgA1.

The constant region of an immunoglobulin is responsible for many important antibody functions, including Fc receptor (FcR) binding and complement fixation. There are five major classes of heavy chain constant region, classified as IgA, IgG, IgD, IgE, IgM, each with characteristic effector functions designated by isotype. For example, IgG is separated into four subclasses known as IgG1, IgG2, IgG3, and IgG4.

Ig molecules interact with multiple classes of cellular receptors. For example, IgG molecules interact with three classes of Fcγ receptors (FcγR) specific for the IgG class of antibody, namely FcγRI, FcγRII, and FcγRIIL. The important sequences for the binding of IgG to the FcγR receptors have been reported to be located in the CH2 and CH3 domains. The serum half-life of an antibody is influenced by the ability of that antibody to bind to an FcR.

In some embodiments, the Fc region is a variant Fc region, e.g., an Fc sequence that has been modified (e.g., by amino acid substitution, deletion and/or insertion) relative to a parent Fc sequence (e.g., an unmodified Fc polypeptide that is subsequently modified to generate a variant), to provide desirable structural features and/or biological activity. For example, one may make modifications in the Fc region in order to generate an Fc variant that (a) has increased or decreased ADCC, (b) increased or decreased CDC, (c) has increased or decreased affinity for Clq and/or (d) has increased or decreased affinity for an Fc receptor relative to the parent Fc. Such Fc region variants will generally comprise at least one amino acid modification in the Fc region. Combining amino acid modifications is thought to be particularly desirable. For example, the variant Fc region may include two, three, four, five, etc. substitutions therein, e.g., of the specific Fc region positions identified herein.

A variant Fc region may also comprise a sequence alteration wherein amino acids involved in disulfide bond formation are removed or replaced with other amino acids. Such removal may avoid reaction with other cysteine-containing proteins present in the host cell used to produce the antibodies described herein. Even when cysteine residues are removed, single chain Fc domains can still form a dimeric Fc domain that is held together non-covalently. In other embodiments, the Fc region may be modified to make it more compatible with a selected host cell. For example, one may remove the PA sequence near the N-terminus of a typical native Fc region, which may be recognized by a digestive enzyme in E. coli such as proline iminopeptidase. In other embodiments, one or more glycosylation sites within the Fc domain may be removed. Residues that are typically glycosylated (e.g., asparagine) may confer cytolytic response. Such residues may be deleted or substituted with unglycosylated residues (e.g., alanine). In other embodiments, sites involved in interaction with complement, such as the Clq binding site, may be removed from the Fc region. For example, one may delete or substitute the EKK sequence of human IgG1. In some embodiments, sites that affect binding to Fc receptors may be removed, preferably sites other than salvage receptor binding sites. In other embodiments, an Fc region may be modified to remove an ADCC site. ADCC sites are known in the art; see, for example, Molec. Immunol. 29 (5): 633-9 (1992) with regard to ADCC sites in IgG1. Specific examples of variant Fc domains are disclosed, for example, in WO 97/34631 and WO 96/32478.

In one embodiment, the hinge region of Fc is modified such that the number of cysteine residues in the hinge region is altered, e.g., increased or decreased. This approach is described further in U.S. Pat. No. 5,677,425 by Bodmer et al. The number of cysteine residues in the hinge region of Fc is altered to, for example, facilitate assembly of the light and heavy chains or to increase or decrease the stability of the antibody. In one embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcal protein A (SpA) binding relative to native Fc-hinge domain SpA binding. This approach is described in further detail in U.S. Pat. No. 6,165,745 by Ward et al.

In yet other embodiments, the Fc region is altered by replacing at least one amino acid residue with a different amino acid residue to alter the effector function(s) of the antibody. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the CI component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered Clq binding and/or reduced or abolished CDC. This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region may be modified to increase ADCC and/or to increase the affinity for an Fcγ receptor by modifying one or more amino acids at the following positions: 234, 235, 236, 238, 239, 240, 241, 243, 244, 245, 247, 248, 249, 252, 254, 255, 256, 258, 262, 263, 264, 265, 267, 268, 269, 270, 272, 276, 278, 280, 283, 285, 286, 289, 290, 292, 293, 294, 295, 296, 298, 299, 301, 303, 305, 307, 309, 312, 313, 315, 320, 322, 324, 325, 326, 327, 329, 330, 331, 332, 333, 334, 335, 337, 338, 340, 360, 373, 376, 378, 382, 388, 389, 398, 414, 416, 419, 430, 433, 434, 435, 436, 437, 438 or 439. Exemplary substitutions include 236A, 239D, 239E, 268D, 267E, 268E, 268F, 324T, 332D, and 332E. Exemplary variants include 239D/332E, 236A/332E, 236A/239D/332E, 268F/324T, 267E/268F, 267E/324T, and 267E/268F7324T. Other modifications for enhancing FcγR and complement interactions include but are not limited to substitutions 298A, 333A, 334A, 326A, 2471, 339D, 339Q, 280H, 290S, 298D, 298V, 243L, 292P, 300L, 396L, 3051, and 396L. These and other modifications are reviewed in Strohl, 2009, Current Opinion in Biotechnology 20:685-691.

Fc modifications that increase binding to an Fcγ receptor include amino acid modifications at any one or more of amino acid positions 238, 239, 248, 249, 252, 254, 255, 256, 258, 265, 267, 268, 269, 270, 272, 279, 280, 283, 285, 298, 289, 290, 292, 293, 294, 295, 296, 298, 301, 303, 305, 307, 312, 315, 324, 327, 329, 330, 335, 337, 3338, 340, 360, 373, 376, 379, 382, 388, 389, 398, 414, 416, 419, 430, 434, 435, 437, 438 or 439 of the Fc region, wherein the numbering of the residues in the Fc region is that of the EU index as in abat (WO00/42072).

Other Fc modifications that can be made to Fcs are those for reducing or ablating binding to FcγR and/or complement proteins, thereby reducing or ablating Fc-mediated effector functions such as ADCC, antibody-dependent cellular phagocytosis (ADCP), and CDC. Exemplary modifications include but are not limited substitutions, insertions, and deletions at positions 234, 235, 236, 237, 267, 269, 325, and 328, wherein numbering is according to the EU index. Exemplary substitutions include but are not limited to 234G, 235G, 236R, 237K, 267R, 269R, 325L, and 328R, wherein numbering is according to the EU index. An Fc variant may comprise 236R/328R. Other modifications for reducing FcγR and complement interactions include substitutions 297A, 234A, 235A, 237A, 318A, 228P, 236E, 268Q, 309L, 330S, 331S, 220S, 226S, 229S, 238S, 233P, and 234V, as well as removal of the glycosylation at position 297 by mutational or enzymatic means or by production in organisms such as bacteria that do not glycosylate proteins. These and other modifications are reviewed in Strohl, 2009, Current Opinion in Biotechnology 20:685-691.

Optionally, the Fc region may comprise a non-naturally occurring amino acid residue at additional and/or alternative positions known to one skilled in the art (see, e.g., U.S. Pat. Nos. 5,624,821; 6,277,375; 6,737,056; 6,194,551; 7,317,091; 8,101,720; WO00/42072; WO01/58957; WO02/06919; WO04/016750; WO04/029207; WO04/035752; WO04/074455; WO04/099249; WO04/063351; WO05/070963; WO05/040217, WO05/092925 and WO06/020114). Fc variants that enhance affinity for an inhibitory receptor FcγRIIb may also be used. Such variants may provide an Fc fusion protein with immune-modulatory activities related to FcγRIIb cells, including, for example, B cells and monocytes. In one embodiment, the Fc variants provide selectively enhanced affinity to FcγRIIb relative to one or more activating receptors. Modifications for altering binding to FcγRIIb include one or more modifications at a position selected from the group consisting of 234, 235, 236, 237, 239, 266, 267, 268, 325, 326, 327, 328, and 332, according to the EU index. Exemplary substitutions for enhancing FcγRIIb affinity include but are not limited to 234D, 234E, 234F, 234W, 235D, 235F, 235R, 235Y, 236D, 236N, 237D, 237N, 239D, 239E, 266M, 267D, 267E, 268D, 268E, 327D, 327E, 328F, 328W, 328Y, and 332E. Exemplary substitutions include 235Y, 236D, 239D, 266M, 267E, 268D, 268E, 328F, 328W, and 328Y. Other Fc variants for enhancing binding to FcγRllb include 235Y/267E, 236D/267E, 239D/268D, 239D/267E, 267E/268D, 267E/268E, and 267E/328F.

The affinities and binding properties of an Fc region for its ligand may be determined by a variety of in vitro assay methods (biochemical or immunological based assays) known in the art including but not limited to, equilibrium methods (e.g., ELISA, or radioimmunoassay), or kinetics (e.g., BIACORE analysis), and other methods such as indirect binding assays, competitive inhibition assays, fluorescence resonance energy transfer (FRET), gel electrophoresis and chromatography (e.g., gel filtration). These and other methods may utilize a label on one or more of the components being examined and/or employ a variety of detection methods including but not limited to chromogenic, fluorescent, luminescent, or isotopic labels. A detailed description of binding affinities and kinetics can be found in Paul, W. E., ed., Fundamental Immunology, 4th Ed., Lippincott-Raven, Philadelphia (1999), which focuses on antibody-immunogen interactions.

In some embodiments, the antibody is modified to increase its biological half-life. Various approaches are possible. For example, this may be done by increasing the binding affinity of the Fc region for FcRn. For example, one or more of the following residues can be mutated: 252, 254, 256, 433, 435, 436, as described in U.S. Pat. No. 6,277,375. Specific exemplary substitutions include one or more of the following: T252L, T254S, and/or T256F. Alternatively, to increase the biological half-life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al. Other exemplary variants that increase binding to FcRn and/or improve pharmacokinetic properties include substitutions at positions 259, 308, 428, and 434, including for example 2591, 308F, 428L, 428M, 434S, 434H, 434F, 434Y, and 434M. Other variants that increase Fc binding to FcRn include: 250E, 250Q, 428L, 428F, 250Q/428L (Hinton et al, 2004, J. Biol. Chem. 279(8): 6213-6216, Hinton et al. 2006 Journal of Immunology 176:346-356), 256A, 272A, 286A, 305A, 307A, 307Q, 311A, 312A, 376A, 378Q, 380A, 382A, 434A (Shields et al, Journal of Biological Chemistry, 2001, 276 (9):6591-6604), 252F, 252T, 252Y, 252W, 254T, 256S, 256R, 256Q, 256E, 256D, 256T, 309P, 311S, 433R, 433S, 4331, 433P, 433Q, 434H, 434F, 434Y, 252Y/254T/256E, 433K/434F/436H, 308T/309P/311S (Dall Acqua et al. Journal of Immunology, 2002, 169:5171-5180, Dall'Acqua et al., 2006, Journal of Biological Chemistry 281:23514-23524). Other modifications for modulating FcRn binding are described in Yeung et al., 2010, J Immunol, 182:7663-7671. In some embodiments, hybrid IgG isotypes with particular biological characteristics may be used. For example, an IgG1/IgG3 hybrid variant may be constructed by substituting IgG 1 positions in the CH2 and/or CH3 region with the amino acids from IgG3 at positions where the two isotypes differ. Thus a hybrid variant IgG antibody may be constructed that comprises one or more substitutions, e.g., 274Q, 276K, 300F, 339T, 356E, 358M, 384S, 392N, 397M, 4221, 435R, and 436F. In other embodiments described herein, an IgG1/IgG2 hybrid variant may be constructed by substituting IgG2 positions in the CH2 and/or CH3 region with amino acids from IgG1 at positions where the two isotypes differ. Thus a hybrid variant IgG antibody may be constructed chat comprises one or more substitutions, e.g., one or more of the following amino acid substitutions: 233E, 234L, 235L, 236G (referring to an insertion of a glycine at position 236), and 321 h.

Moreover, the binding sites on human IgG1 for FcγRI, FcγRII, FcγRIII, and FcRn have been mapped and variants with improved binding have been described (see Shields, R. L. et al. (2001) J. Biol. Chem. 276:6591-6604). Specific mutations at positions 256, 290, 298, 333, 334, and 339 were shown to improve binding to FcγRIII Additionally, the following combination mutants were shown to improve FcγRIII binding: T256A/S298A, S298A/E333A, S298A/K224A, and S298A/E333A/K334A, which has been shown to exhibit enhanced FcγRIIIa binding and ADCC activity (Shields et al., 2001). Other IgG1 variants with strongly enhanced binding to FcγRIIIa have been identified, including variants with S239D/I332E and S239D/I332E/A330L mutations which showed the greatest increase in affinity for FcγRIIIa, a decrease in FcγRIIb binding, and strong cytotoxic activity in cynomolgus monkeys (Lazar et al., 2006). Introduction of the triple mutations into antibodies such as alemtuzumab (CD52-specific), trastuzumab (HER2/neu-specific), rituximab (CD20-specific), and cetuximab (EGFR-specific) translated into greatly enhanced ADCC activity in vitro, and the S239D/I332E variant showed an enhanced capacity to deplete B cells in monkeys (Lazar et al., 2006). In addition, IgG1 mutants containing L235V, F243L, R292P, Y300L and P396L mutations which exhibited enhanced binding to FcγRIIIa and concomitantly enhanced ADCC activity in transgenic mice expressing human FcγRIIIa in models of B cell malignancies and breast cancer have been identified (Stavenhagen et al., 2007; Nordstrom et al., 2011). Other Fc mutants that may be used include: S298A/E333A/L334A, S239D/I332E, S239D/I332E/A330L, L235V/F243L/R292P/Y300L/P396L, and M428L/N434S.

In some embodiments, an Fc is chosen that has reduced binding to FcγRs. An exemplary Fc, e.g., IgG1 Fc, with reduced FcγR binding, comprises the following three amino acid substitutions: L234A, L235E, and G237A.

In some embodiments, an Fc is chosen that has reduced complement fixation. An exemplary Fc, e.g., IgG1 Fc, with reduced complement fixation, has the following two amino acid substitutions: A330S and P331S.

In some embodiments, an Fc is chosen that has essentially no effector function, i.e., it has reduced binding to FcγRs and reduced complement fixation. An exemplary Fc, e.g., IgG1 Fc, that is effectorless, comprises the following five mutations: L234A, L235E, G237A, A330S, and P331S.

When using an IgG4 constant domain, it is usually preferable to include the substitution S228P, which mimics the hinge sequence in IgG1 and thereby stabilizes IgG4 molecules.

f. Multivalent Antibodies

In one embodiment, the antibodies of the invention may be monovalent or multivalent (e.g., bivalent, trivalent, etc.). As used herein, the term "valency" refers to the number of potential target binding sites associated with an antibody. Each target binding site specifically binds one target molecule or specific position or locus on a target molecule. When an antibody is monovalent, each binding site of the molecule will specifically bind to a single antigen position or epitope. When an antibody comprises more than one target binding site (multivalent), each target binding site may specifically bind the same or different molecules (e.g., may bind to different ligands or different antigens, or different epitopes or positions on the same antigen). See, for example, U.S.P.N. 2009/0129125. In each case, at least one of the binding sites will comprise an epitope, motif or domain associated with a DLL3 isoform.

In one embodiment, the antibodies are bispecific antibodies in which the two chains have different specificities, as described in Millstein et al., 1983, Nature, 305:537-539. Other embodiments include antibodies with additional specificities such as trispecific antibodies. Other more sophisticated compatible multispecific constructs and methods of their fabrication are set forth in U.S.P.N. 2009/0155255, as well as WO 94/04690; Suresh et al., 1986, Methods in Enzymology, 121:210; and WO96/27011.

As stated above, multivalent antibodies may immunospecifically bind to different epitopes of the desired target molecule or may immunospecifically bind to both the target molecule as well as a heterologous epitope, such as a heterologous polypeptide or solid support material. In some embodiments, the multivalent antibodies may include bispecific antibodies or trispecific antibodies. Bi specific antibodies also include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art and are disclosed in U.S. Pat. No. 4,676,980, along with a number of cross-linking techniques.

In some embodiments, antibody variable domains with the desired binding specificities (antibody-antigen combining sites) are fused to immunoglobulin constant domain sequences, such as an immunoglobulin heavy chain constant domain comprising at least part of the hinge, CH2, and/or CH3 regions, using methods well known to those of ordinary skill in the art.

g. Antibody Derivatives

An antibody provided herein may be further modified to contain additional nonproteinaceous moieties that are known in the art and readily available. The moieties suitable for derivatization of the antibody include but are not limited to water-soluble polymers.

Non-limiting examples of water-soluble polymers include, but are not limited to, PEG, copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight and may be branched or unbranched. The number of polymers attached to the antibody may vary, and if more than one polymer is attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., Proc. Natl. Acad. Sci. USA 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

Another modification of the antibodies described herein is pegylation. An antibody can be pegylated to, for example, increase the biological (e.g., serum) half-life of the antibody. To pegylate an antibody, the antibody, or fragment thereof, typically is reacted with PEG, such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (CI-CIO) alkoxy- or aryloxy-polyethylene glycol or polyethylene glycol-maleimide. In some embodiments, the antibody to be pegylated is an aglycosylated antibody. Methods for pegylating proteins are known in the art and can be applied to the antibodies described herein. See, for example, EP 0 154 316 by Nishimura et al. and EP0401384 by Ishikawa et al.

The present invention also encompasses a human monoclonal antibody described herein conjugated to a therapeutic agent, a polymer, a detectable label or enzyme. In one embodiment, the therapeutic agent is a cytotoxic agent. In one embodiment, the polymer is PEG.

h. Nucleic Acids, Expression Cassettes, and Vectors

The present invention provides isolated nucleic acid segments that encode the polypeptides, peptide fragments, and coupled proteins of the invention. The nucleic acid segments of the invention also include segments that encode for the same amino acids due to the degeneracy of the genetic code. For example, the amino acid threonine is encoded by ACU, ACC, ACA, and ACG and is therefore degenerate. It is intended that the invention includes all variations of the polynucleotide segments that encode for the same amino acids. Such mutations are known in the art (Watson et al., Molecular Biology of the Gene, Benjamin Cummings 1987). Mutations also include alteration of a nucleic acid segment to encode for conservative amino acid changes, for example, the substitution of leucine for isoleucine and so forth. Such mutations are also known in the art. Thus, the genes and nucleotide sequences of the invention include both the naturally occurring sequences as well as mutant forms.

The nucleic acid segments of the invention may be contained within a vector. A vector may include, but is not limited to, any plasmid, phagemid, F-factor, virus, cosmid, or phage in a double- or single-stranded linear or circular form which may or may not be self transmissible or mobilizable. The vector can also transform a prokaryotic or eukaryotic host either by integration into the cellular genome or exist extra-chromosomally (e.g., autonomous replicating plasmid with an origin of replication).

Preferably the nucleic acid segment in the vector is under the control of, and operably linked to, an appropriate promoter or other regulatory elements for transcription in vitro or in a host cell, such as a eukaryotic cell, or a microbe, e.g., bacteria. The vector may be a shuttle vector that functions in multiple hosts. The vector may also be a cloning vector that typically contains one or a small number of restriction endonuclease recognition sites at which foreign DNA sequences can be inserted in a determinable fashion. Such insertion can occur without loss of essential biological function of the cloning vector. A cloning vector may also contain a marker gene that is suitable for use in the identification and selection of cells transformed with the cloning vector. Examples of marker genes are tetracycline resistance or ampicillin resistance. Many cloning vectors are commercially available (Stratagene, New England Biolabs, Clonetech).

The nucleic acid segments of the invention may also be inserted into an expression vector. Typically an expression vector contains prokaryotic DNA elements coding for a bacterial replication origin and an antibiotic resistance gene to provide for the amplification and selection of the expression vector in a bacterial host; regulatory elements that control initiation of transcription such as a promoter; and DNA elements that control the processing of transcripts such as introns, or a transcription termination/polyadenylation sequence.

Methods to introduce nucleic acid segment into a vector are available in the art (Sambrook et al., Molecular Cloning: A Laboratory Manual, 3rd edition, Cold Spring Harbor Press, Cold Spring Harbor, N.Y. (2001)). Briefly, a vector into which a nucleic acid segment is to be inserted is treated with one or more restriction enzymes (restriction endonuclease) to produce a linearized vector having a blunt end, a "sticky" end with a 5' or a 3' overhang, or any combination of the above. The vector may also be treated with a restriction enzyme and subsequently treated with another modifying enzyme, such as a polymerase, an exonuclease, a phosphatase or a kinase, to create a linearized vector that has characteristics useful for ligation of a nucleic acid segment into the vector. The nucleic acid segment that is to be inserted into the vector is treated with one or more restriction enzymes to create a linearized segment having a blunt end, a "sticky" end with a 5' or a 3' overhang, or any combination of the above. The nucleic acid segment may also be treated with a restriction enzyme and subsequently treated with another DNA modifying enzyme. Such DNA modifying enzymes include, but are not limited to, polymerase, exonuclease, phosphatase or a kinase, to create a nucleic acid segment that has characteristics useful for ligation of a nucleic acid segment into the vector.

The treated vector and nucleic acid segment are then ligated together to form a construct containing a nucleic acid segment according to methods available in the art (Sambrook et al., Molecular Cloning: A Laboratory Manual, 3rd edition, Cold Spring Harbor Press, Cold Spring Harbor, N.Y. (2001)). Briefly, the treated nucleic acid fragment, and the treated vector are combined in the presence of a suitable buffer and ligase. The mixture is then incubated under appropriate conditions to allow the ligase to ligate the nucleic acid fragment into the vector.

The invention also provides an expression cassette which contains a nucleic acid sequence capable of directing expression of a particular nucleic acid segment of the invention, either in vitro or in a host cell. Also, a nucleic acid segment of the invention may be inserted into the expression cassette such that an anti-sense message is produced. The expression cassette is an isolatable unit such that the expression cassette may be in linear form and functional for in vitro transcription and translation assays. The materials and procedures to conduct these assays are commercially available from Promega Corp. (Madison, Wis.). For example, an in vitro transcript may be produced by placing a nucleic acid sequence under the control of a T7 promoter and then using T7 RNA polymerase to produce an in vitro transcript. This transcript may then be translated in vitro through use of a rabbit reticulocyte lysate. Alternatively, the expression cassette can be incorporated into a vector allowing for replication and amplification of the expression cassette within a host cell or also in vitro transcription and translation of a nucleic acid segment.

Such an expression cassette may contain one or a plurality of restriction sites allowing for placement of the nucleic acid segment under the regulation of a regulatory sequence. The expression cassette can also contain a termination signal operably linked to the nucleic acid segment as well as regulatory sequences required for proper translation of the nucleic acid segment. The expression cassette containing the nucleic acid segment may be chimeric, meaning that at least one of its components is heterologous with respect to at least one of its other components. The expression cassette may also be one that is naturally occurring but has been obtained in a recombinant form useful for heterologous expression. Expression of the nucleic acid segment in the expression cassette may be under the control of a constitutive promoter or an inducible promoter, which initiates transcription only when the host cell is exposed to some particular external stimulus.

The expression cassette may include in the 5'-3' direction of transcription, a transcriptional and translational initiation region, a nucleic acid segment and a transcriptional and translational termination region functional in vivo and/or in vitro. The termination region may be native with the transcriptional initiation region, may be native with the nucleic acid segment, or may be derived from another source.

The regulatory sequence can be a polynucleotide sequence located upstream (5' non-coding sequences), within, or downstream (3' non-coding sequences) of a coding sequence, and which influences the transcription, RNA processing or stability, or translation of the associated coding sequence. Regulatory sequences can include, but are not limited to, enhancers, promoters, repressor binding sites, translation leader sequences, introns, and polyadenylation signal sequences. They may include natural and synthetic sequences as well as sequences, which may be a combination of synthetic and natural sequences. While regulatory sequences are not limited to promoters, some useful regulatory sequences include constitutive promoters, inducible promoters, regulated promoters, tissue-specific promoters, viral promoters, and synthetic promoters.

A promoter is a nucleotide sequence that controls the expression of the coding sequence by providing the recognition for RNA polymerase and other factors required for proper transcription. A promoter includes a minimal promoter, consisting only of all basal elements needed for transcription initiation, such as a TATA-box and/or initiator that is a short DNA sequence comprised of a TATA-box and other sequences that serve to specify the site of transcription initiation, to which regulatory elements are added for control of expression. A promoter may be derived entirely from a native gene, or be composed of different elements derived from different promoters found in nature, or even be comprised of synthetic DNA segments. A promoter may contain DNA sequences that are involved in the binding of protein factors that control the effectiveness of transcription initiation in response to physiological or developmental conditions.

The invention also provides a construct containing a vector and an expression cassette. The vector may be selected from, but not limited to, any vector previously described. Into this vector may be inserted an expression cassette through methods known in the art and previously described (Sambrook et al., Molecular Cloning: A Laboratory Manual, 3rd edition, Cold Spring Harbor Press, Cold Spring Harbor, N.Y. (2001)). In one embodiment, the regulatory sequences of the expression cassette may be derived from a source other than the vector into which the expression cassette is inserted. In another embodiment, a construct containing a vector and an expression cassette is formed upon insertion of a nucleic acid segment of the invention into a vector that itself contains regulatory sequences. Thus, an expression cassette is formed upon insertion of the nucleic acid segment into the vector. Vectors containing regulatory sequences are available commercially, and methods for their use are known in the art (Clonetech, Promega, Stratagene).

In another aspect, this disclosure also provides (i) a nucleic acid molecule encoding a polypeptide chain of the antibody or antigen-binding fragment thereof described above; (ii) a vector comprising the nucleic acid molecule as described; and (iii) a cultured host cell comprising the vector as described. Also provided is a method for producing a polypeptide, comprising: (a) obtaining the cultured host cell as described; (b) culturing the cultured host cell in a medium under conditions permitting expression of a polypeptide encoded by the vector and assembling of an antibody or fragment thereof; and (c) purifying the antibody or fragment from the cultured cell or the medium of the cell.

i. Methods of Production

Antibodies may be produced using recombinant methods and compositions, e.g., as described in U.S. Pat. No. 4,816,567. In one embodiment, an isolated nucleic acid encoding an antibody described herein is provided. Such nucleic acid may encode an amino acid sequence comprising the VL and/or an amino acid sequence comprising the VH of the antibody (e.g., the light and/or heavy chains of the antibody). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody. In one embodiment, the host cell is eukaryotic, e.g., a Chinese Hamster Ovary (CHO) cell or lymphoid cell (e.g., Y0, NS0, Sp20 cell). In one embodiment, a method of making an antibody is provided, wherein the method comprises culturing a host cell comprising a nucleic acid encoding the antibody, as provided above, under conditions suitable for expression of the antibody, and optionally recovering the antibody from the host cell (or host cell culture medium).

For recombinant production of an antibody, a nucleic acid encoding an antibody, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody).

Suitable host cells for cloning or expression of antibody-encoding vectors include prokaryotic or eukaryotic cells described herein. For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, Methods in Molecular Biology, Vol. 248 (B. K. C. Lo, ed., Humana Press, Totowa, N.J., 2003), pp. 245-254, describing expression of antibody fragments in *E. coli*.) After expression, the antibody may be isolated from the bacterial cell paste in a soluble fraction and can be further purified.

In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gerngross, Nat. Biotech. 22:1409-1414 (2004), and Li et al., Nat. Biotech. 24:210-215 (2006).

Suitable host cells for the expression of glycosylated antibody are also derived from multicellular organisms (invertebrates and vertebrates). Examples of invertebrate cells include plant and insect cells. Numerous baculoviral strains have been identified, which may be used in conjunction with insect cells, particularly for transfection of *Spodoptera frugiperda* cells.

Plant cell cultures can also be utilized as hosts. See, e.g., U.S. Pat. Nos. 5,959,177, 6,040,498, 6,420,548, 7,125,978, and 6,417,429 (describing PLANTIBODIES technology for producing antibodies in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., J. Gen Virol. 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., Annals N.Y. Acad. Sci. 383:44-68 (1982); MRC 5 cells; and FS4 cells. Other useful mammalian host cell lines include CHO cells, including DHFR-CHO cells (Urlaub et al., Proc. Natl. Acad. Sci. USA 77:4216 (1980)); and myeloma cell lines such as Y0, NS0, and Sp2/0. For a review of certain mammalian host cell lines suitable for antibody production, see, e.g., Yazaki and Wu, Methods in Molecular Biology, Vol. 248 (B. K. C. Lo, ed., Humana Press, Totowa, N.J.), pp. 255-268 (2003).

B. COMPOSITIONS AND FORMULATIONS

The antibodies of this invention represent an excellent way for the development of antiviral therapies either alone or in antibody cocktails with additional anti-SARS-CoV-2 virus antibodies for the treatment of human SARS-CoV-2 infections in humans.

In another aspect, the present invention provides a pharmaceutical composition comprising the antibodies of the present invention described herein formulated together with a pharmaceutically acceptable carrier. The composition may optionally contain one or more additional pharmaceutically active ingredients, such as another antibody or a therapeutic agent.

In some embodiments, the pharmaceutical comprises two or more of the antibody or antigen-binding fragment thereof of described above, such as any combinations of the antibody or antigen-binding fragment thereof comprising a heavy chain and a light chain that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the two or more of the antibody or antigen-binding fragment thereof comprise: (1) a first antibody set comprising: (i) a first antibody or antigen-binding fragment thereof comprising a heavy chain variable region and a light chain variable region comprising the respective amino acid sequences of SEQ ID NOs: 57-58; and (ii) a second antibody or antigen-binding fragment thereof comprising a heavy chain variable region and a light chain variable region comprising the respective amino acid sequences of SEQ ID NOs: 1-2, 55-56, 57-58, 65-66, 81-82, or 85-86; or (2) a second antibody set comprising: (a) a third antibody or antigen-binding fragment thereof comprising a heavy chain variable region and a light chain variable region comprising the respective amino acid sequences of of SEQ ID NOs: 13-14, 49-50, 85-86113-114, 125-126, 2876 and 2888, or 2900 and 2912; and (b) a fourth antibody or antigen-binding fragment thereof comprising a heavy chain variable region and a light chain variable region comprising the respective amino acid sequences of of SEQ ID NOs: 13-14, 49-50, 85-86, 113-114, 125-126, 2876 and 2888, or 2900 and 2912, wherein the third antibody is different from the fourth antibody.

The pharmaceutical compositions of the invention also can be administered in a combination therapy with, for example, another immune-stimulatory agent, an antiviral agent, or a vaccine, etc. In some embodiments, a composition comprises an antibody of this invention at a concentration of at least 1 mg/ml, 5 mg/ml, 10 mg/ml, 50 mg/ml, 100 mg/ml, 150 mg/ml, 200 mg/ml, 1-300 mg/ml, or 100-300 mg/ml.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

Also within the scope of this disclosure is use of the pharmaceutical composition in the preparation of a medicament for the diagnosis, prophylaxis, treatment, or combination thereof of a condition resulting from a SARS-CoV-2.

The pharmaceutical composition can comprise any number of excipients. Excipients that can be used include carriers, surface-active agents, thickening or emulsifying agents, solid binders, dispersion or suspension aids, solubilizers, colorants, flavoring agents, coatings, disintegrating agents, lubricants, sweeteners, preservatives, isotonic agents, and combinations thereof. The selection and use of suitable excipients is taught in Gennaro, ed., Remington: The Science and Practice of Pharmacy, 20th Ed. (Lippincott Williams & Wilkins 2003), the disclosure of which is incorporated herein by reference.

Preferably, a pharmaceutical composition is suitable for intravenous, intramuscular, subcutaneous, parenteral, spinal or epidermal administration (e.g., by injection or infusion). Depending on the route of administration, the active compound can be coated in a material to protect it from the action of acids and other natural conditions that may inactivate it. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, an antibody of the present invention described herein can be administered via a non-parenteral route, such as a topical, epidermal or mucosal route of administration, e.g., intranasally, orally, vaginally, rectally, sublingually or topically.

The pharmaceutical compositions of the invention may be prepared in many forms that include tablets, hard or soft gelatin capsules, aqueous solutions, suspensions, and liposomes and other slow-release formulations, such as shaped polymeric gels. An oral dosage form may be formulated such that the antibody is released into the intestine after passing through the stomach. Such formulations are described in U.S. Pat. No. 6,306,434 and in the references contained therein.

Oral liquid pharmaceutical compositions may be in the form of, for example, aqueous or oily suspensions, solutions, emulsions, syrups or elixirs, or may be presented as a dry product for constitution with water or other suitable vehicle before use. Such liquid pharmaceutical compositions may contain conventional additives such as suspending agents, emulsifying agents, non-aqueous vehicles (which may include edible oils), or preservatives.

An antibody can be formulated for parenteral administration (e.g., by injection, for example, bolus injection or continuous infusion) and may be presented in unit dosage form in ampules, prefilled syringes, small volume infusion containers or multi-dose containers with an added preservative. The pharmaceutical compositions may take such forms as suspensions, solutions, or emulsions in oily or aqueous vehicles, and may contain formulatory agents such as suspending, stabilizing and/or dispersing agents. Pharmaceutical compositions suitable for rectal administration can be prepared as unit dose suppositories. Suitable carriers include saline solution and other materials commonly used in the art.

For administration by inhalation, an antibody can be conveniently delivered from an insufflator, nebulizer or a pressurized pack or other convenient means of delivering an aerosol spray. Pressurized packs may comprise a suitable propellant such as dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount.

Alternatively, for administration by inhalation or insufflation, an antibody may take the form of a dry powder composition, for example, a powder mix of a modulator and a suitable powder base such as lactose or starch. The powder composition may be presented in unit dosage form in, for example, capsules or cartridges or, e.g., gelatin or blister packs from which the powder may be administered with the aid of an inhalator or insufflator. For intra-nasal administration, an antibody may be administered via a liquid spray, such as via a plastic bottle atomizer.

Pharmaceutical compositions of the invention may also contain other ingredients such as flavorings, colorings, antimicrobial agents, or preservatives. It will be appreciated that the amount of an antibody required for use in treatment will vary not only with the particular carrier selected but also with the route of administration, the nature of the condition being treated and the age and condition of the patient. Ultimately the attendant health care provider may determine proper dosage. In addition, a pharmaceutical composition may be formulated as a single unit dosage form.

The pharmaceutical composition of the present invention can be in the form of sterile aqueous solutions or dispersions. It can also be formulated in a microemulsion, liposome, or other ordered structure suitable to high drug concentration.

An antibody of the present invention described herein can be administered as a sustained release formulation, in which case less frequent administration is required. Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably, until the patient shows partial or complete amelioration of symptoms of disease. Thereafter, the patient can be administered a prophylactic regime.

The amount of active ingredient that can be combined with a carrier material to produce a single dosage form will vary depending upon the subject being treated and the particular mode of administration and will generally be that amount of the composition, which produces a therapeutic effect. Generally, out of one hundred percent, this amount will range from about 0.01% to about 99% of active ingredient, preferably from about 0.1% to about 70%, most preferably from about 1% to about 30% of active ingredient in combination with a pharmaceutically acceptable carrier.

Dosage regimens can be adjusted to provide the optimum desired response (e.g., a therapeutic response). For example, a single bolus can be administered, several divided doses can be administered over time or the dose can be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. Alternatively, the antibody can be administered as a sustained release formulation, in which case less frequent administration is required. For administration of the antibody, the dosage ranges from about 0.0001 to 800 mg/kg, and more usually 0.01 to 5 mg/kg, of the host body weight. For example dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Preferred dosage regimens for an antibody of the invention include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks. In some methods, dosage is adjusted to achieve a plasma antibody concentration of about 1-1000 µg/ml and in some methods about 25-300 µg/ml. A "therapeutically effective dosage" of an antibody of the invention preferably results in a decrease in severity of disease symptoms, an increase in frequency and duration of disease symptom-free periods, or a prevention of impairment or disability due to the disease affliction. For example, for the treatment of SARS-CoV-2 infection in a subject, a "therapeutically effective dosage" preferably inhibits SARS-CoV-2 virus replication or uptake by host cells by at least about 20%, more preferably by at least about 40%, even more preferably by at least about 60%, and still more preferably by at least about 80% relative to untreated subjects. A therapeutically effective amount of a therapeutic compound can neutralize SARS-CoV-2 virus, or otherwise ameliorate symptoms in a subject, which is typically a human or can be another mammal.

The pharmaceutical composition can be a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. See, e.g., Sustained and Controlled Release Drug Delivery Systems, J. R. Robinson, ed., Marcel Dekker, Inc., New York, 1978.

Therapeutic compositions can be administered via medical devices such as (1) needleless hypodermic injection devices (e.g., U.S. Pat. Nos. 5,399,163; 5,383,851; 5,312,335; 5,064,413; 4,941,880; 4,790,824; and 4,596,556); (2) micro-infusion pumps (U.S. Pat. No. 4,487,603); (3) transdermal devices (U.S. Pat. No. 4,486,194); (4) infusion apparati (U.S. Pat. Nos. 4,447,233 and 4,447,224); and (5) osmotic devices (U.S. Pat. Nos. 4,439,196 and 4,475,196); the disclosures of which are incorporated herein by reference.

In some embodiments, the human monoclonal antibodies of the invention described herein can be formulated to ensure proper distribution in vivo. For example, to ensure that the therapeutic compounds of the invention cross the blood-brain barrier, they can be formulated in liposomes, which may additionally comprise targeting moieties to enhance selective transport to specific cells or organs. See, e.g., U.S. Pat. Nos. 4,522,811; 5,374,548; 5,416,016; and 5,399,331; V. V. Ranade (1989) Clin. Pharmacol. 29:685; Umezawa et al., (1988) Biochem. Biophys. Res. Commun. 153:1038; Bloeman et al. (1995) FEBS Lett. 357:140; M. Owais et al. (1995) Antimicrob. Agents Chemother. 39:180; Briscoe et al. (1995) Am. Physiol. 1233:134; Schreier et al. (1994). Biol. Chem. 269:9090; Keinanen and Laukkanen (1994) FEBS Lett. 346:123; and Killion and Fidler (1994) Immunomethods 4:273.

In some embodiments, the initial dose may be followed by administration of a second or a plurality of subsequent doses of the antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor-mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. The pharmaceutical composition can also be delivered in a vesicle, in particular, a liposome (see, for example, Langer (1990) Science 249: 1527-1533).

The use of nanoparticles to deliver the antibodies of the present invention is also contemplated herein. Antibody-conjugated nanoparticles may be used both for therapeutic and diagnostic applications. Antibody-conjugated nanoparticles and methods of preparation and use are described in detail by Arruebo, M., et al. 2009 ("Antibody-conjugated nanoparticles for biomedical applications" in J. Nanomat. Volume 2009, Article ID 439389), incorporated herein by reference. Nanoparticles may be developed and conjugated to antibodies contained in pharmaceutical compositions to target cells. Nanoparticles for drug delivery have also been described in, for example, U.S. Pat. No. 8,257,740, or U.S. Pat. No. 8,246,995, each incorporated herein in its entirety.

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous, intracranial, intraperitoneal and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L. P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the antibody contained is generally about 5 to about 500 mg per dosage form in a unit dose; especially in the form of injection, it is preferred that the antibody is contained in about 5 to about 300 mg and in about 10 to about 300 mg for the other dosage forms.

C. METHODS AND USES a. Methods of Treatment

The antibodies, compositions, and formulations described herein can be used to neutralize SARS-CoV-2 virus and thereby treating or preventing SARS-CoV-2 infections.

Accordingly, in one aspect, this disclosure further provides a method of neutralizing SARS-CoV-2 in a subject, comprising administering to a subject in need thereof a therapeutically effective amount of the antibody or antigen-binding fragment thereof or a therapeutically effective amount of the pharmaceutical composition, as described above.

In another aspect, this disclosure additionally provides a method of preventing or treating a SARS-CoV-2 infection, comprising administering to a subject in need thereof a therapeutically effective amount of the antibody or antigen-binding fragment thereof or a therapeutically effective amount of the pharmaceutical composition, as described above.

The neutralizing of the SARS-CoV-2 virus can be done via (i) inhibiting SARS-CoV-2 virus binding to a target cell; (ii) inhibiting SARS-CoV-2 virus uptake by a target cell; (iii) inhibiting SARS-CoV-2 virus replication; and (iv) inhibiting SARS-CoV-2 virus particles release from infected cells. One skilled in the art possesses the ability to perform any assay to assess neutralization of SARS-CoV-2 virus.

Notably, the neutralizing properties of antibodies may be assessed by a variety of tests, which all may assess the consequences of (i) inhibition of SARS-CoV-2 virus binding to a target cell; (ii) inhibition of SARS-CoV-2 virus uptake by a target cell; (iii) inhibition of SARS-CoV-2 virus replication; and (iv) inhibition of SARS-CoV-2 virus particles release from infected cells. In other words, implementing different tests may lead to the observation of the same consequence, i.e., the loss of infectivity of the SARS-CoV-2 virus. Thus, in one embodiment, the present invention provides a method of neutralizing SARS-CoV-2 virus in a subject comprising administering to the subject a therapeutically effective amount of the antibody of the present invention described herein.

Another aspect of the present invention provides a method of treating a SARS-CoV-2-related disease. Such a method includes therapeutic (following SARS-CoV-2 infection) and prophylactic (prior to SARS-CoV-2 exposure, infection or pathology). For example, therapeutic and prophylactic methods of treating an individual for a SARS-CoV-2 infection include treatment of an individual having or at risk of having a SARS-CoV-2 infection or pathology, treating an individual with a SARS-CoV-2 infection, and methods of protecting an individual from a SARS-CoV-2 infection, to decrease or reduce the probability of a SARS-CoV-2 infection in an individual, to decrease or reduce susceptibility of an individual to a SARS-CoV-2 infection, or to inhibit or prevent a SARS-CoV-2 infection in an individual, and to decrease, reduce, inhibit or suppress transmission of a SARS-CoV-2 from an infected individual to an uninfected individual. Such methods include administering an antibody of the present invention or a composition comprising the antibody disclosed herein to therapeutically or prophylactically treat (vaccinate or immunize) an individual having or at risk of having a SARS-CoV-2 infection or pathology. Accordingly, methods can treat the SARS-CoV-2 infection or pathology, or provide the individual with protection from infection (e.g., prophylactic protection).

In one embodiment, a method of treating a SARS-CoV-2-related disease comprises administering to an individual in need thereof an antibody or therapeutic composition disclosed herein in an amount sufficient to reduce one or more physiological conditions or symptoms associated with a SARS-CoV-2 infection or pathology, thereby treating the SARS-CoV-2-related disease.

In one embodiment, an antibody or therapeutic composition disclosed herein is used to treat a SARS-CoV-2-related disease. Use of an antibody or therapeutic composition disclosed herein treats a SARS-CoV-2-related disease by reducing one or more physiological conditions or symptoms associated with a SARS-CoV-2 infection or pathology. In aspects of this embodiment, administration of an antibody or therapeutic composition disclosed herein is in an amount sufficient to reduce one or more physiological conditions or symptoms associated with a SARS-CoV-2 infection or pathology, thereby treating the SARS-CoV-2-based disease. In other aspects of this embodiment, administration of an antibody or therapeutic composition disclosed herein is in an amount sufficient to increase, induce, enhance, augment, promote or stimulate SARS-CoV-2 clearance or removal; or decrease, reduce, inhibit, suppress, prevent, control, or limit transmission of SARS-CoV-2 to another individual.

One or more physiological conditions or symptoms associated with a SARS-CoV-2 infection or pathology will respond to a method of treatment disclosed herein. The symptoms of SARS-CoV-2 infection or pathology vary, depending on the phase of infection.

In some embodiments, the method of neutralizing SARS-CoV-2 in a subject comprises administering to a subject in need thereof a therapeutically effective amount of a first antibody or antigen-binding fragment thereof and a second antibody or antigen-binding fragment thereof of the antibody or antigen-binding fragment or a therapeutically effective amount of the pharmaceutical composition, as described above, wherein the first antibody or antigen-binding fragment thereof and the second antibody or antigen binding fragment thereof exhibit synergistic activity.

In some embodiments, the method of preventing or treating a SARS-CoV-2 infection, comprising administering to a subject in need thereof a therapeutically effective amount of a first antibody or antigen-binding fragment thereof and a second antibody or antigen-binding fragment thereof of the antibody or antigen-binding fragment or a therapeutically effective amount of the pharmaceutical composition, as described above, wherein the first antibody or antigen-binding fragment thereof and the second antibody or antigen binding fragment thereof exhibit synergistic activity. In some embodiments, the first antibody or antigen-binding fragment thereof is administered before, after, or concurrently with the second antibody or antigen-binding fragment thereof.

In some embodiments, the first antibody or antigen-binding fragment thereof and the second antibody or antigen-binding fragment thereof can be any combinations of the antibody or antigen-binding fragment thereof comprising a heavy chain and a light chain that comprise the respective amino acid sequences of SEQ ID NOs: 1-2; 13-14; 25-26; 49-50, 55-56, 57-58, 65-66, 81-82, 85-86, 113-114, 125-126, 2876 and 2888, or 2900 and 2912.

In some embodiments, the first antibody or antigen-binding fragment thereof comprises a heavy chain variable region and a light chain variable region comprising the respective amino acid sequences of SEQ ID NOs: 57-58 and the second antibody or antigen-binding fragment thereof comprises a heavy chain variable region and a light chain variable region comprising the respective amino acid sequences of SEQ ID NOs: 1-2, 55-56, 57-58, 65-66, 81-82, or 85-86.

In some embodiments, the first antibody or antigen-binding fragment thereof comprises a heavy chain variable region and a light chain variable region comprising the respective amino acid sequences of SEQ ID NOs: 13-14, 49-50, 85-86, 113-114, 125-126, 2876 and 2888, or 2900 and 2912, and the second antibody or antigen-binding fragment thereof comprises a heavy chain variable region and a light chain variable region comprising the respective amino acid sequences of SEQ ID NOs: 13-14, 49-50, 85-86, 113-114, 125-126, 2876 and 2888, or 2900 and 2912, wherein the first antibody and the second antibody are different.

In some embodiments, the method comprises administering to the subject a therapeutically effective amount of a second therapeutic agent or therapy. In some embodiments, the antibody or antigen-binding fragment thereof comprises a heavy chain variable region and a light chain variable region comprising the respective amino acid sequences of SEQ ID NOs: 57-58; and the second therapeutic agent or therapy comprises an antibody or antigen-binding fragment thereof comprising a heavy chain variable region and a light chain variable region that comprise the respective amino acid sequences of SEQ ID NOs: 1-2, 55-56, 57-58, 65-66, 81-82, or 85-86.

In some embodiments, the second therapeutic agent comprises an anti-inflammatory drug or an antiviral compound. In some embodiments, the antiviral compound comprises: a nucleoside analog, a peptoid, an oligopeptide, a polypeptide, a protease inhibitor, a 3C-like protease inhibitor, a papain-like protease inhibitor, or an inhibitor of an RNA dependent RNA polymerase. In some embodiments, the antiviral compound may include: acyclovir, gancyclovir, vidarabine, foscarnet, cidofovir, amantadine, ribavirin, trifluorothymidine, zidovudine, didanosine, zalcitabine or an interferon. In some embodiments, the interferon is an interferon-α or an interferon-β.

In some embodiments, the antibody or antigen-binding fragment thereof is administered before, after, or concurrently with the second therapeutic agent or therapy. In some embodiments, the antibody or antigen-binding fragment thereof is administered to the subject intravenously, subcutaneously, or intraperitoneally. In some embodiments, the antibody or antigen-binding fragment thereof is administered prophylactically or therapeutically.

The antibodies described herein can be used together with one or more of other anti-SARS-CoV-2 virus antibodies to neutralize SARS-CoV-2 virus and thereby treating SARS-CoV-2 infections.

b. Combination Therapies

Combination therapies may include an anti-SARS-CoV-2 antibody of the invention and any additional therapeutic agent that may be advantageously combined with an antibody of the invention or with a biologically active fragment of an antibody of the invention. The antibodies of the present invention may be combined synergistically with one or more drugs or therapy used to treat a disease or disorder associated with a viral infection, such as a SARS-CoV-2 infection. In some embodiments, the antibodies of the invention may be combined with a second therapeutic agent to ameliorate one or more symptoms of said disease. In some embodiments, the antibodies of the invention may be combined with a second antibody to provide synergistic activity in ameliorating one or more symptoms of said disease. In some embodiments, the first antibody or antigen-binding fragment thereof is administered before, after, or concurrently with the second antibody or antigen-binding fragment thereof.

For example, the antibody described herein can be used in various detection methods for use in, e.g., monitoring the progression of a SARS-CoV-2 infection; monitoring patient response to treatment for such an infection, etc. The present disclosure provides methods of detecting a neuraminidase polypeptide in a biological sample obtained from an individual. The methods generally involve: a) contacting the biological sample with a subject anti-neuraminidase antibody; and b) detecting binding, if any, of the antibody to an epitope present in the sample. In some instances, the antibody comprises a detectable label. The level of neuraminidase polypeptide detected in the biological sample can provide an indication of the stage, degree, or severity of a SARS-CoV-2 infection. The level of the neuraminidase polypeptide detected in the biological sample can provide an indication of the individual's response to treatment for a SARS-CoV-2 infection.

In some embodiments, the second therapeutic agent is another antibody to a SARS-COV-2 protein or a fragment thereof. It is contemplated herein to use a combination ("cocktail") of antibodies with broad neutralization or inhibitory activity against SARS-COV-2. In some embodiments, non-competing antibodies may be combined and administered to a subject in need thereof. In some embodiments, the antibodies comprising the combination bind to distinct non-overlapping epitopes on the protein. In some embodiments, the second antibody may possess longer half-life in human serum.

As used herein, the term "in combination with" means that additional therapeutically active component(s) may be administered prior to, concurrent with, or after the administration of the anti-SARS-COV-2 antibody of the present invention. The term "in combination with" also includes sequential or concomitant administration of an anti-SARS-COV-2 antibody and a second therapeutic agent.

The additional therapeutically active component(s) may be administered to a subject prior to administration of an anti-SARS-COV-2 antibody of the present invention. For example, a first component may be deemed to be administered "prior to" a second component if the first component is administered 1 week before, 72 hours before, 60 hours before, 48 hours before, 36 hours before, 24 hours before, 12 hours before, 6 hours before, 5 hours before, 4 hours before, 3 hours before, 2 hours before, 1 hour before, 30 minutes before, 15 minutes before, 10 minutes before, 5 minutes before, or less than 1 minute before administration of the second component. In other embodiments, the additional therapeutically active component(s) may be administered to a subject after administration of an anti-SARS-COV-2 antibody of the present invention. For example, a first component may be deemed to be administered "after" a second component if the first component is administered 1 minute after, 5 minutes after, 10 minutes after, 15 minutes after, 30 minutes after, 1 hour after, 2 hours after, 3 hours after, 4 hours after, 5 hours after, 6 hours after, 12 hours after, 24 hours after, 36 hours after, 48 hours after, 60 hours after, 72 hours after administration of the second component. In yet other embodiments, the additional therapeutically active component(s) may be administered to a subject concurrent with administration of an anti-SARS-COV-2 antibody of the present invention. "Concurrent" administration, for purposes of the present invention, includes, e.g., administration of an anti-SARS-COV-2 antibody and an additional therapeutically active component to a subject in a single dosage form, or in separate dosage forms administered to the subject within about 30 minutes or less of each other. If administered in separate dosage forms, each dosage form may be administered via the same route (e.g., both the anti-SARS-COV-2 antibody and the additional therapeutically active component may be administered intravenously, etc.); alternatively, each dosage form may be administered via a different route (e.g., the anti-SARS-COV-2 antibody may be administered intravenously, and the additional therapeutically active component may be administered orally). In any event, administering the components in a single dosage from, in separate dosage forms by the same route, or in separate dosage forms by different routes are all considered "concurrent administration," for purposes of the present disclosure. For purposes of the present disclosure, administration of an anti-SARS-COV-2 antibody "prior to," "concurrent with," or "after" (as those terms are defined hereinabove) administration of an additional therapeutically active component is considered administration of an anti-SARS-COV-2 antibody "in combination with" an additional therapeutically active component.

The present invention includes pharmaceutical compositions in which an anti-SARS-COV-2 antibody of the present invention is co-formulated with one or more of the additional therapeutically active component(s) as described elsewhere herein.

c. Administration Regimens

According to certain embodiments, a single dose of an anti-SARS-COV-2 antibody of the invention (or a pharmaceutical composition comprising a combination of an anti-SARS-COV-2 antibody and any of the additional therapeutically active agents mentioned herein) may be administered to a subject in need thereof. According to certain embodiments of the present invention, multiple doses of an anti-SARS-COV-2 antibody (or a pharmaceutical composition comprising a combination of an anti-SARS-COV-2 antibody and any of the additional therapeutically active agents mentioned herein) may be administered to a subject over a defined time course. The methods according to this aspect of the invention comprise sequentially administering to a subject multiple doses of an anti-SARS-COV-2 antibody of the invention. As used herein, "sequentially administering" means that each dose of anti-SARS-COV-2 antibody is administered to the subject at a different point in time, e.g., on different days separated by a predetermined interval (e.g., hours, days, weeks or months). The present invention includes methods which comprise sequentially administering to the patient a single initial dose of an anti-SARS-COV-2 antibody, followed by one or more secondary doses of the anti-SARS-COV-2 antibody, and optionally followed by one or more tertiary doses of the anti-SARS-COV-2 antibody.

The terms "initial dose," "secondary doses," and "tertiary doses," refer to the temporal sequence of administration of the anti-SARS-COV-2 antibody of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of anti-SARS-COV-2 antibody, but generally may differ from one another in terms of frequency of administration. In some embodiments, however, the amount of anti-SARS-COV-2 antibody contained in the initial, secondary and/or tertiary doses varies from one another (e.g., adjusted up or down as appropriate) during the course of treatment. In some embodiments, two or more (e.g., 2, 3, 4, or 5) doses are administered at the beginning of the treatment regimen as "loading doses" followed by subsequent doses that are administered on a less frequent basis (e.g., "maintenance doses").

In certain exemplary embodiments of the present invention, each secondary and/or tertiary dose is administered 1 to 48 hours (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) after the immediately preceding dose. The phrase "the immediately preceding dose," as used herein, means, in a sequence of multiple administrations, the dose of anti-SARS-COV-2 antibody, which is administered to a patient prior to the administration of the very next dose in the sequence with no intervening doses.

The methods, according to this aspect of the invention, may comprise administering to a patient any number of secondary and/or tertiary doses of an anti-SARS-COV-2 antibody. For example, In some embodiments, only a single secondary dose is administered to the patient. In other embodiments, two or more (e.g., 2, 3, 4, 5, 6, 7, 8, or more)

secondary doses are administered to the patient. Likewise, In some embodiments, only a single tertiary dose is administered to the patient. In other embodiments, two or more (e.g., 2, 3, 4, 5, 6, 7, 8, or more) tertiary doses are administered to the patient.

In some embodiments of the invention, the frequency at which the secondary and/or tertiary doses are administered to a patient can vary over the course of the treatment regimen. The frequency of administration may also be adjusted during the course of treatment by a physician depending on the needs of the individual patient following clinical examination.

d. Diagnostic Uses of the Antibodies

The anti-SARS-COV-2 antibodies of the present invention may be used to detect and/or measure SARS-COV-2 in a sample, e.g., for diagnostic purposes. Some embodiments contemplate the use of one or more antibodies of the present invention in assays to detect a SARS-COV-2-associated-disease or disorder. Exemplary diagnostic assays for SARS-COV-2 may comprise, e.g., contacting a sample, obtained from a patient, with an anti-SARS-COV-2 antibody of the invention, wherein the anti-SARS-COV-2 antibody is labeled with a detectable label or reporter molecule or used as a capture ligand to selectively isolate SARS-COV-2 from patient samples. Alternatively, an unlabeled anti-SARS-COV-2 antibody can be used in diagnostic applications in combination with a secondary antibody, which is itself detectably labeled. The detectable label or reporter molecule can be a radioisotope, such as H, C, P, S, or I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure SARS-COV-2 in a sample include enzyme-linked immunosorbent assay (ELISA), radioimmunoassay (MA), and fluorescence-activated cell sorting (FACS).

In another aspect, this disclosure further provides a method for detecting the presence of SARS CoV-2 in a sample comprising the steps of: (i) contacting a sample with the antibody or antigen-binding fragment thereof described above; and (ii) determining binding of the antibody or antigen-binding fragment to one or more SARS CoV-2 antigens, wherein binding of the antibody to the one or more SARS CoV-2 antigens is indicative of the presence of SARS CoV-2 in the sample.

In some embodiments, the SARS-CoV-2 antigen comprises a S polypeptide, such as a S polypeptide of a human or an animal SARS-CoV-2. In some embodiments, the SARS-CoV-2 antigen comprises the receptor-binding domain (RBD) of the S polypeptide. In some embodiments, the RBD comprises amino acids 319-541 of the S polypeptide.

In some embodiments, the antibody or antigen-binding fragment thereof is conjugated to a label. In some embodiments, the step of detecting comprises contacting a secondary antibody with the antibody or antigen-binding fragment thereof and wherein the secondary antibody comprises a label. In some embodiments, the label includes a fluorescent label, a chemiluminescent label, a radiolabel, and an enzyme.

In some embodiments, the step of detecting comprises detecting fluorescence or chemiluminescence. In some embodiments, the step of detecting comprises a competitive binding assay or ELISA.

In some embodiments, the method further comprises binding the sample to a solid support. In some embodiments, the solid support includes microparticles, microbeads, magnetic beads, and an affinity purification column.

Samples that can be used in SARS-COV-2 diagnostic assays according to the present invention include any tissue or fluid sample obtainable from a patient, which contains detectable quantities of either SARS-COV-2 protein, or fragments thereof, under normal or pathological conditions. Generally, levels of SARS-COV-2 protein in a particular sample obtained from a healthy patient (e.g., a patient not afflicted with a disease associated with SARS-COV-2) will be measured to initially establish a baseline, or standard, level of SARS-COV-2. This baseline level of SARS-COV-2 can then be compared against the levels of SARS-COV-2 measured in samples obtained from individuals suspected of having a SARS-COV-2-associated condition, or symptoms associated with such condition.

The antibodies specific for SARS-COV-2 protein may contain no additional labels or moieties, or they may contain an N-terminal or C-terminal label or moiety. In one embodiment, the label or moiety is biotin. In a binding assay, the location of a label (if any) may determine the orientation of the peptide relative to the surface upon which the peptide is bound. For example, if a surface is coated with avidin, a peptide containing an N-terminal biotin will be oriented such that the C-terminal portion of the peptide will be distal to the surface.

D. KITS

In another aspect, this disclosure provides a kit comprising a pharmaceutically acceptable dose unit of the antibody or antigen-binding fragment thereof of or the pharmaceutical composition as described above. Also within the scope of this disclosure is a kit for the diagnosis, prognosis or monitoring the treatment of SARS-CoV-2 in a subject, comprising: the antibody or antigen-binding fragment thereof as described; and a least one detection reagent that binds specifically to the antibody or antigen-binding fragment thereof.

In some embodiments, the kit also includes a container that contains the composition and optionally informational material. The informational material can be descriptive, instructional, marketing or other material that relates to the methods described herein and/or the use of the agents for therapeutic benefit. In an embodiment, the kit also includes an additional therapeutic agent, as described above. For example, the kit includes a first container that contains the composition and a second container for the additional therapeutic agent.

The informational material of the kits is not limited in its form. In some embodiments, the informational material can include information about production of the composition, concentration, date of expiration, batch or production site information, and so forth. In one embodiment, the informational material relates to methods of administering the composition, e.g., in a suitable dose, dosage form, or mode of administration (e.g., a dose, dosage form, or mode of administration described herein), to treat a subject in need thereof. In one embodiment, the instructions provide a dosing regimen, dosing schedule, and/or route of administration of the composition or the additional therapeutic agent. The information can be provided in a variety of formats, including printed text, computer-readable material, video recording, or audio recording, or information that contains a link or address to substantive material.

The kit can include one or more containers for the composition. In some embodiments, the kit contains separate containers, dividers or compartments for the composition and informational material. For example, the composition can be contained in a bottle or vial, and the informational material can be contained in a plastic sleeve or packet. In other embodiments, the separate elements of the kit are contained within a single, undivided container. For example, the composition is contained in a bottle or vial that has attached thereto the informational material in the form of a label. In some embodiments, the kit includes a plurality (e.g., a pack) of individual containers, each containing one or more unit dosage forms (e.g., a dosage form described herein) of the agents.

The kit optionally includes a device suitable for administration of the composition or other suitable delivery device. The device can be provided pre-loaded with one or both of the agents or can be empty, but suitable for loading. Such a kit may optionally contain a syringe to allow for injection of the antibody contained within the kit into an animal, such as a human.

E. DEFINITIONS

To aid in understanding the detailed description of the compositions and methods according to the disclosure, a few express definitions are provided to facilitate an unambiguous disclosure of the various aspects of the disclosure. Unless otherwise defined, all technical and scientific terms used herein have the same meaning as commonly understood by one of ordinary skill in the art to which this disclosure belongs.

The term "antibody" as referred to herein includes whole antibodies and any antigen-binding fragment or single chains thereof. Whole antibodies are glycoproteins comprising at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. The heavy chain variable region CDRs and FRs are HFR1, HCDR1, HFR2, HCDR2, HFR3, HCDR3, HFR4. The light chain variable region CDRs and FRs are LFR1, LCDR1, LFR2, LCDR2, LFR3, LCDR3, LFR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (CIq) of the classical complement system.

The term "antigen-binding fragment or portion" of an antibody (or simply "antibody fragment or portion"), as used herein, refers to one or more fragments of an antibody that retain the ability to specifically bind to an antigen (e.g., a Spike or S protein of SARS-CoV-2 virus). It has been shown that the antigen-binding function of an antibody can be performed by fragments of a full-length antibody. Examples of binding fragments encompassed within the term "antigen-binding fragment or portion" of an antibody include (i) a Fab fragment, a monovalent fragment consisting of the VL, VH, CL and CHI domains; (ii) a F(ab')2 fragment, a bivalent fragment comprising two Fab fragments linked by a disulfide bridge at the hinge region; (iii) a Fab' fragment, which is essentially a Fab with part of the hinge region (see, FUNDAMENTAL IMMUNOLOGY (Paul ed., 3rd ed. 1993)); (iv) a Fd fragment consisting of the VH and CHI domains; (v) a Fv fragment consisting of the VL and VH domains of a single arm of an antibody, (vi) a dAb fragment (Ward et al., (1989) Nature 341:544-546), which consists of a VH domain; (vii) an isolated CDR; and (viii) a nanobody, a heavy chain variable region containing a single variable domain and two constant domains. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv or scFv); see, e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding fragment or portion" of an antibody. These antibody fragments are obtained using conventional techniques known to those with skill in the art, and the fragments are screened for utility in the same manner as are intact antibodies.

An "isolated antibody," as used herein, is intended to refer to an antibody that is substantially free of other antibodies having different antigenic specificities (e.g., an isolated antibody that specifically binds to a Spike or S protein of SARS-CoV-2 virus is substantially free of antibodies that specifically bind antigens other than the neuraminidase). An isolated antibody can be substantially free of other cellular material and/or chemicals.

The terms "monoclonal antibody" or "monoclonal antibody composition" as used herein refer to a preparation of antibody molecules of single molecular composition. A monoclonal antibody composition displays a single binding specificity and affinity for a particular epitope.

The term "human antibody" is intended to include antibodies having variable regions in which both the framework and CDR regions are derived from human germline immunoglobulin sequences. Furthermore, if the antibody contains a constant region, the constant region also is derived from human germline immunoglobulin sequences. The human antibodies of the invention can include amino acid residues not encoded by human germline immunoglobulin sequences (e.g., mutations introduced by random or site-specific mutagenesis in vitro or by somatic mutation in vivo). However, the term "human antibody," as used herein, is not intended to include antibodies in which CDR sequences derived from the germline of another mammalian species, such as a mouse, have been grafted onto human framework sequences.

The term "human monoclonal antibody" refers to antibodies displaying a single binding specificity, which have variable regions in which both the framework and CDR regions are derived from human germline immunoglobulin sequences. In one embodiment, the human monoclonal antibodies can be produced by a hybridoma that includes a B cell obtained from a transgenic nonhuman animal, e.g., a transgenic mouse, having a genome comprising a human heavy chain transgene and a light chain transgene fused to an immortalized cell.

The term "recombinant human antibody," as used herein, includes all human antibodies that are prepared, expressed, created or isolated by recombinant means, such as (a) antibodies isolated from an animal (e.g., a mouse) that is transgenic or transchromosomal for human immunoglobulin genes or a hybridoma prepared therefrom (described further below), (b) antibodies isolated from a host cell transformed to express the human antibody, e.g., from a transfectoma, (c) antibodies isolated from a recombinant, combinatorial human antibody library, and (d) antibodies prepared, expressed, created or isolated by any other means that involve splicing of human immunoglobulin gene sequences to other DNA sequences. Such recombinant human antibodies have variable regions in which the framework and CDR regions are derived from human germline immunoglobulin sequences. In some embodiments, however, such recombinant human antibodies can be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "isotype" refers to the antibody class (e.g., IgM or IgG1) that is encoded by the heavy chain constant region genes. The phrases "an antibody recognizing an antigen" and "an antibody specific for an antigen" are used interchangeably herein with the term "an antibody which binds specifically to an antigen."

The term "human antibody derivatives" refers to any modified form of the human antibody, e.g., a conjugate of the antibody and another agent or antibody. The term "humanized antibody" is intended to refer to antibodies in which CDR sequences derived from the germline of another mammalian species, such as a mouse, have been grafted onto human framework sequences. Additional framework region modifications can be made within the human framework sequences.

The term "chimeric antibody" is intended to refer to antibodies in which the variable region sequences are derived from one species, and the constant region sequences are derived from another species, such as an antibody in which the variable region sequences are derived from a mouse antibody, and the constant region sequences are derived from a human antibody. The term can also refer to an antibody in which its variable region sequence or CDR(s) is derived from one source (e.g., an IgA1 antibody) and the constant region sequence or Fc is derived from a different source (e.g., a different antibody, such as an IgG, IgA2, IgD, IgE or IgM antibody).

The invention encompasses isolated or substantially purified nucleic acids, peptides, polypeptides or proteins. In the context of the present invention, an "isolated" nucleic acid, DNA or RNA molecule or an "isolated" polypeptide is a nucleic acid, DNA molecule, RNA molecule, or polypeptide that exists apart from its native environment and is therefore not a product of nature. An isolated nucleic acid, DNA molecule, RNA molecule or polypeptide may exist in a purified form or may exist in a non-native environment such as, for example, a transgenic host cell. A "purified" nucleic acid molecule, peptide, polypeptide or protein, or a fragment thereof, is substantially free of other cellular material, or culture medium when produced by recombinant techniques, or substantially free of chemical precursors or other chemicals when chemically synthesized. In one embodiment, an "isolated" nucleic acid is free of sequences that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein, peptide or polypeptide that is substantially free of cellular material includes preparations of protein, peptide or polypeptide having less than about 30%, 20%, 10%, or 5% (by dry weight) of contaminating protein. When the protein of the invention, or biologically active portion thereof, is recombinantly produced, preferably culture medium represents less than about 30%, 20%, 10%, or 5% (by dry weight) of chemical precursors or non-protein-of-interest chemicals. The terms polypeptide, peptide, and protein are used interchangeably herein.

The terms "polypeptide," "peptide," and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, pegylation, or any other manipulation, such as conjugation with a labeling component. As used herein, the term "amino acid" includes natural and/or unnatural or synthetic amino acids, including glycine and both the D or L optical isomers, and amino acid analogs and peptidomimetics.

A peptide or polypeptide "fragment" as used herein refers to a less than full-length peptide, polypeptide or protein. For example, a peptide or polypeptide fragment can have is at least about 3, at least about 4, at least about 5, at least about 10, at least about 20, at least about 30, at least about 40 amino acids in length, or single unit lengths thereof. For example, fragment may be 6, 7, 8, 9, 10, 11, 12, 13, 14, 15, 16, 17, or more amino acids in length. There is no upper limit to the size of a peptide fragment. However, in some embodiments, peptide fragments can be less than about 500 amino acids, less than about 400 amino acids, less than about 300 amino acids or less than about 250 amino acids in length. Preferably the peptide fragment can elicit an immune response when used to inoculate an animal. A peptide fragment may be used to elicit an immune response by inoculating an animal with a peptide fragment in combination with an adjuvant, a peptide fragment that is coupled to an adjuvant, or a peptide fragment that is coupled to arsanilic acid, sulfanilic acid, an acetyl group, or a picryl group. A peptide fragment can include a non-amide bond and can be a peptidomimetic.

As used herein, the term "conjugate" or "conjugation" or "linked" as used herein refers to the attachment of two or more entities to form one entity. A conjugate encompasses both peptide-small molecule conjugates as well as peptide-protein/peptide conjugates.

The term "recombinant," as used herein, refers to antibodies or antigen-binding fragments thereof of the invention created, expressed, isolated or obtained by technologies or methods known in the art as recombinant DNA technology which include, e.g., DNA splicing and transgenic expression. The term refers to antibodies expressed in a non-human mammal (including transgenic non-human mammals, e.g., transgenic mice), or a cell (e.g., CHO cells) expression system or isolated from a recombinant combinatorial human antibody library.

A "nucleic acid" or "polynucleotide" refers to a DNA molecule (for example, but not limited to, a cDNA or genomic DNA) or an RNA molecule (for example, but not limited to, an mRNA), and includes DNA or RNA analogs. A DNA or RNA analog can be synthesized from nucleotide analogs. The DNA or RNA molecules may include portions that are not naturally occurring, such as modified bases, modified backbone, deoxyribonucleotides in an RNA, etc. The nucleic acid molecule can be single-stranded or double-stranded.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 90% sequence identity, even more preferably at least 95%, 98% or 99% sequence identity. Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. See, e.g., Pearson (1994) Methods Mol. Biol. 24: 307-331, which is herein incorporated by reference. Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45, herein incorporated by reference. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions, and other modifications, including conservative amino acid substitutions. For instance, GCG software contains programs such as GAP and BESTFIT, which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215: 403-410 and (1997) Nucleic Acids Res. 25:3389-3402, each of which is herein incorporated by reference.

As used herein, the term "affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity, which reflects a 1:1 interaction between members of a binding pair (e.g., antibody and antigen). The affinity of a molecule X for its partner Y can generally be represented by the dissociation constant (KD). Affinity can be measured by common methods known in the art, including those described herein.

The term "specifically binds," or "binds specifically to," or the like, refers to an antibody that binds to a single epitope, e.g., under physiologic conditions, but which does not bind to more than one epitope. Accordingly, an antibody that specifically binds to a polypeptide will bind to an epitope that present on the polypeptide, but which is not present on other polypeptides. Specific binding can be characterized by an equilibrium dissociation constant of at least about $1 \times 10^{-8}$ M or less (e.g., a smaller KD denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIA-CORE™, which bind specifically to a Spike or S protein of SARS-CoV-2 virus.

Preferably, the antibody binds to a Spike or S protein with "high affinity," namely with a KD of $1 \times 10^{-7}$ M or less, more preferably $5 \times 10^{-8}$ M or less, more preferably $3 \times 10^{-8}$ M or less, more preferably $1 \times 10^{-8}$ M or less, more preferably $5 \times 10^{-9}$ M or less or even more preferably $1 \times 10^{-9}$ M or less, as determined by surface plasmon resonance, e.g., BIACORE. The term "does not substantially bind" to a protein or cells, as used herein, means does not bind or does not bind with a high affinity to the protein or cells, i.e., binds to the protein or cells with a KD of $1 \times 10^{-6}$ M or more, more preferably $1 \times 10^{-5}$ M or more, more preferably $1 \times 10^{-4}$ M or more, more preferably $1 \times 10^{-3}$ M or more, even more preferably $1 \times 10^{-2}$ M or more.

The term "Kassoc" or "Ka," as used herein, is intended to refer to the association rate of a particular antibody-antigen interaction, whereas the term "Kdis" or "Kd," as used herein, is intended to refer to the dissociation rate of a particular antibody-antigenn interaction. The term "KD," as used herein, is intended to refer to the dissociation constant, which is obtained from the ratio of Kd to Ka (i.e., Kd/Ka) and is expressed as a molar concentration (M). KD values for antibodies can be determined using methods well established in the art. A preferred method for determining the KD of an antibody is by using surface plasmon resonance, preferably using a biosensor system such as a BIACORE system.

Antibodies that "compete with another antibody for binding to a target" refer to antibodies that inhibit (partially or completely) the binding of the other antibody to the target. Whether two antibodies compete with each other for binding to a target, i.e., whether and to what extent one antibody inhibits the binding of the other antibody to a target, may be determined using known competition experiments. In some embodiments, an antibody competes with, and inhibits binding of another antibody to a target by at least 10%, 20%, 30%, 40%, 50%, 60%, 70%, 80%, 90% or 100%. The level of inhibition or competition may be different depending on which antibody is the "blocking antibody" (i.e., the cold antibody that is incubated first with the target). Competition assays can be conducted as described, for example, in Ed Harlow and David Lane, Cold Spring Harb Protoc; 2006 or in Chapter 11 of "Using Antibodies" by Ed Harlow and David Lane, Cold Spring Harbor Laboratory Press, Cold Spring Harbor, N.Y., USA 1999. Competing antibodies bind to the same epitope, an overlapping epitope or to adjacent epitopes (e.g., as evidenced by steric hindrance). Other competitive binding assays include: solid phase direct or indirect radioimmunoassay (MA), solid phase direct or indirect enzyme immunoassay (EIA), sandwich competition assay (see Stahli et al., Methods in Enzymology 9:242 (1983)); solid phase direct biotin-avidin EIA (see Kirkland et al., J. Immunol. 137:3614 (1986)); solid phase direct labeled assay, solid phase direct labeled sandwich assay (see Harlow and Lane, Antibodies: A Laboratory Manual, Cold Spring Harbor Press (1988)); solid phase direct label RIA using 1-125 label (see Morel et al., Mol. Immunol. 25(1):7 (1988)); solid phase direct biotin-avidin EIA (Cheung et al., Virology 176:546 (1990)); and direct labeled RIA. (Moldenhauer et al., Scand. J. Immunol. 32:77 (1990)).

The term "epitope" as used herein refers to an antigenic determinant that interacts with a specific antigen-binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In some embodiments, epitopes may include determinants that are chemically active surface groupings of molecules such as amino acids, sugar side chains, phosphoryl groups, or sulfonyl groups, and, In some embodiments, may have specific three-dimensional structural characteristics, and/or specific charge characteristics. An epitope typically includes at least 3, 4, 5, 6, 7, 8, 9, 10, 11, 12, 13, 14 or 15 amino acids in a unique spatial conformation. Methods for determining what epitopes are bound by a given antibody (i.e., epitope mapping) are well known in the art and include, for example, immunoblotting and immune-precipitation assays, wherein overlapping or contiguous peptides from a Spike or S protein are tested for reactivity with a given antibody. Methods of determining spatial conformation of epitopes include techniques in the art and those described herein, for example, x-ray crystallography and 2-dimensional nuclear magnetic resonance (see, e.g., Epitope Mapping Protocols in Methods in Molecular Biology, Vol. 66, G. E. Morris, Ed. (1996)).

The term "epitope mapping" refers to the process of identification of the molecular determinants for antibody-antigen recognition.

The term "binds to an epitope" or "recognizes an epitope" with reference to an antibody or antibody fragment refers to continuous or discontinuous segments of amino acids within an antigen. Those of skill in the art understand that the terms do not necessarily mean that the antibody or antibody fragment is in direct contact with every amino acid within an epitope sequence.

The term "binds to the same epitope" with reference to two or more antibodies means that the antibodies bind to the same, overlapping or encompassing continuous or discontinuous segments of amino acids. Those of skill in the art understand that the phrase "binds to the same epitope" does not necessarily mean that the antibodies bind to or contact exactly the same amino acids. The precise amino acids that the antibodies contact can differ. For example, a first antibody can bind to a segment of amino acids that is completely encompassed by the segment of amino acids bound by a second antibody. In another example, a first antibody binds one or more segments of amino acids that significantly overlap the one or more segments bound by the second antibody. For the purposes herein, such antibodies are considered to "bind to the same epitope."

As used herein, the term "immune response" refers to a biological response within a vertebrate against foreign agents, which response protects the organism against these agents and diseases caused by them. An immune response is mediated by the action of a cell of the immune system (for example, a T lymphocyte, B lymphocyte, natural killer (NK) cell, macrophage, eosinophil, mast cell, dendritic cell or neutrophil) and soluble macromolecules produced by any of these cells or the liver (including antibodies, cytokines, and complement) that results in selective targeting, binding to, damage to, destruction of, and/or elimination from the vertebrate's body of invading pathogens, cells or tissues infected with pathogens, cancerous or other abnormal cells, or, in cases of autoimmunity or pathological inflammation, normal human cells or tissues. An immune reaction includes, e.g., activation or inhibition of a T cell, e.g., an effector T cell or a Th cell, such as a CD4+ or CD8+ T cell, or the inhibition of a Treg cell.

The term "detectable label" as used herein refers to a molecule capable of detection, including, but not limited to, radioactive isotopes, fluorescers, chemiluminescers, chromophores, enzymes, enzyme substrates, enzyme cofactors, enzyme inhibitors, chromophores, dyes, metal ions, metal sols, ligands (e.g., biotin, avidin, streptavidin or haptens), intercalating dyes and the like. The term "fluorescer" refers to a substance or a portion thereof that is capable of exhibiting fluorescence in the detectable range.

In many embodiments, the terms "subject" and "patient" are used interchangeably irrespective of whether the subject has or is currently undergoing any form of treatment. As used herein, the terms "subject" and "subjects" may refer to any vertebrate, including, but not limited to, a mammal (e.g., cow, pig, camel, llama, horse, goat, rabbit, sheep, hamsters, guinea pig, cat, dog, rat, and mouse, a non-human primate (for example, a monkey, such as a cynomolgus monkey, chimpanzee, etc.) and a human). The subject may be a human or a non-human. In more exemplary aspects, the mammal is a human. As used herein, the expression "a subject in need thereof" or "a patient in need thereof" means a human or non-human mammal that exhibits one or more symptoms or indications of disorders (e.g., neuronal disorders, autoimmune diseases, and cardiovascular diseases), and/or who has been diagnosed with inflammatory disorders. In some embodiments, the subject is a mammal. In some embodiments, the subject is human.

As used herein, the term "disease" is intended to be generally synonymous and is used interchangeably with, the terms "disorder" and "condition" (as in medical condition), in that all reflect an abnormal condition (e.g., inflammatory disorder) of the human or animal body or of one of its parts that impairs normal functioning, is typically manifested by distinguishing signs and symptoms, and causes the human or animal to have a reduced duration or quality of life.

As used herein, the term "treating" or "treatment" of any disease or disorder refers in one embodiment, to ameliorating the disease or disorder (i.e., arresting or reducing the development of the disease or at least one of the clinical symptoms thereof). In another embodiment, "treating" or "treatment" refers to ameliorating at least one physical parameter, which may not be discernible by the patient. In yet another embodiment, "treating" or "treatment" refers to modulating the disease or disorder, either physically, (e.g., stabilization of a discernible symptom), physiologically, (e.g., stabilization of a physical parameter), or both. In yet another embodiment, "treating" or "treatment" refers to preventing or delaying the onset or development or progression of the disease or disorder.

The terms "prevent," "preventing," "prevention," "prophylactic treatment" and the like refer to reducing the probability of developing a disorder or condition in a subject, who does not have, but is at risk of or susceptible to developing a disorder or condition.

The terms "decrease," "reduced," "reduction," "decrease," or "inhibit" are all used herein generally to mean a decrease by a statistically significant amount. However, for avoidance of doubt, "reduced," "reduction" or "decrease" or "inhibit" means a decrease by at least 10% as compared to a reference level, for example, a decrease by at least about 20%, or at least about 30%, or at least about 40%, or at least about 50%, or at least about 60%, or at least about 70%, or at least about 80%, or at least about 90% or up to and including a 100% decrease (e.g., absent level as compared to a reference sample), or any decrease between 10-100% as compared to a reference level.

As used herein, the term "agent" denotes a chemical compound, a mixture of chemical compounds, a biological macromolecule (such as a nucleic acid, an antibody, a protein or portion thereof, e.g., a peptide), or an extract made from biological materials such as bacteria, plants, fungi, or animal (particularly mammalian) cells or tissues. The activity of such agents may render it suitable as a "therapeutic agent," which is a biologically, physiologically, or pharmacologically active substance (or substances) that acts locally or systemically in a subject.

As used herein, the terms "therapeutic agent," "therapeutic capable agent," or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder, or condition; and generally counteracting a disease, symptom, disorder or pathological condition.

The term "therapeutic effect" is art-recognized and refers to a local or systemic effect in animals, particularly mammals, and more particularly humans caused by a pharmacologically active substance.

The term "effective amount," "effective dose," or "effective dosage" is defined as an amount sufficient to achieve or at least partially achieve a desired effect. A "therapeutically effective amount" or "therapeutically effective dosage" of a drug or therapeutic agent is any amount of the drug that, when used alone or in combination with another therapeutic agent, promotes disease regression evidenced by a decrease in severity of disease symptoms, an increase in frequency and duration of disease symptom-free periods, or a prevention of impairment or disability due to the disease affliction. A "prophylactically effective amount" or a "prophylactically effective dosage" of a drug is an amount of the drug that, when administered alone or in combination with another therapeutic agent to a subject at risk of developing a disease or of suffering a recurrence of disease, inhibits the development or recurrence of the disease. The ability of a therapeutic or prophylactic agent to promote disease regression or inhibit the development or recurrence of the disease can be evaluated using a variety of methods known to the skilled practitioner, such as in human subjects during clinical trials, in animal model systems predictive of efficacy in humans, or by assaying the activity of the agent in in vitro assays.

Doses are often expressed in relation to bodyweight. Thus, a dose which is expressed as [g, mg, or other unit]/kg (or g, mg etc.) usually refers to [g, mg, or other unit] "per kg (or g, mg etc.) bodyweight," even if the term "bodyweight" is not explicitly mentioned.

As used herein, the term "composition" or "pharmaceutical composition" refers to a mixture of at least one component useful within the invention with other components, such as carriers, stabilizers, diluents, dispersing agents, suspending agents, thickening agents, and/or excipients. The pharmaceutical composition facilitates administration of one or more components of the invention to an organism.

As used herein, the term "pharmaceutically acceptable" refers to a material, such as a carrier or diluent, which does not abrogate the biological activity or properties of the composition, and is relatively non-toxic, i.e., the material may be administered to an individual without causing undesirable biological effects or interacting in a deleterious manner with any of the components of the composition in which it is contained.

As used herein, the term "pharmaceutically acceptable carrier" includes a pharmaceutically acceptable salt, pharmaceutically acceptable material, composition or carrier, such as a liquid or solid filler, diluent, excipient, solvent or encapsulating material, involved in carrying or transporting a compound(s) of the present invention within or to the subject such that it may perform its intended function. Typically, such compounds are carried or transported from one organ, or portion of the body, to another organ, or portion of the body. Each salt or carrier must be "acceptable" in the sense of being compatible with the other ingredients of the formulation and not injurious to the subject. Some examples of materials that may serve as pharmaceutically acceptable carriers include: sugars, such as lactose, glucose, and sucrose; starches, such as corn starch and potato starch; cellulose, and its derivatives, such as sodium carboxymethyl cellulose, ethyl cellulose, and cellulose acetate; powdered tragacanth; malt; gelatin; talc; excipients, such as cocoa butter and suppository waxes; oils, such as peanut oil, cottonseed oil, safflower oil, sesame oil, olive oil, corn oil, and soybean oil; glycols, such as propylene glycol; polyols, such as glycerin, sorbitol, mannitol, and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; diluent; granulating agent; lubricant; binder; disintegrating agent; wetting agent; emulsifier; coloring agent; release agent; coating agent; sweetening agent; flavoring agent; perfuming agent; preservative; antioxidant; plasticizer; gelling agent; thickener; hardener; setting agent; suspending agent; surfactant; humectant; carrier; stabilizer; and other non-toxic compatible substances employed in pharmaceutical formulations, or any combination thereof. As used herein, "pharmaceutically acceptable carrier" also includes any and all coatings, antibacterial and antifungal agents, and absorption delaying agents, and the like that are compatible with the activity of one or more components of the invention, and are physiologically acceptable to the subject. Supplementary active compounds may also be incorporated into the compositions.

"Combination" therapy, as used herein, unless otherwise clear from the context, is meant to encompass administration of two or more therapeutic agents in a coordinated fashion and includes, but is not limited to, concurrent dosing. Specifically, combination therapy encompasses both co-administration (e.g., administration of a co-formulation or simultaneous administration of separate therapeutic compositions) and serial or sequential administration, provided that administration of one therapeutic agent is conditioned in some way on the administration of another therapeutic agent. For example, one therapeutic agent may be administered only after a different therapeutic agent has been administered and allowed to act for a prescribed period of time. See, e.g., Kohrt et al. (2011) Blood 117:2423.

As used herein, the term "co-administration" or "co-administered" refers to the administration of at least two agent(s) or therapies to a subject. In some embodiments, the co-administration of two or more agents/therapies is concurrent. In other embodiments, a first agent/therapy is administered prior to a second agent/therapy. Those of skill in the art understand that the formulations and/or routes of administration of the various agents/therapies used may vary.

As used herein, the term "contacting," when used in reference to any set of components, includes any process whereby the components to be contacted are mixed into the same mixture (for example, are added into the same compartment or solution), and does not necessarily require actual physical contact between the recited components. The recited components can be contacted in any order or any combination (or sub-combination) and can include situations where one or some of the recited components are subsequently removed from the mixture, optionally prior to addition of other recited components. For example, "contacting A with B and C" includes any and all of the following situations: (i) A is mixed with C, then B is added to the mixture; (ii) A and B are mixed into a mixture; B is removed from the mixture, and then C is added to the mixture; and (iii) A is added to a mixture of B and C.

"Sample," "test sample," and "patient sample" may be used interchangeably herein. The sample can be a sample of serum, urine plasma, amniotic fluid, cerebrospinal fluid, cells, or tissue. Such a sample can be used directly as obtained from a patient or can be pre-treated, such as by filtration, distillation, extraction, concentration, centrifugation, inactivation of interfering components, addition of reagents, and the like, to modify the character of the sample in some manner as discussed herein or otherwise as is known in the art. The terms "sample" and "biological sample" as used herein generally refer to a biological material being tested for and/or suspected of containing an analyte of interest such as antibodies. The sample may be any tissue sample from the subject. The sample may comprise protein from the subject.

As used herein, the term "in vitro" refers to events that occur in an artificial environment, e.g., in a test tube or reaction vessel, in cell culture, etc., rather than within a multi-cellular organism.

As used herein, the term "in vivo" refers to events that occur within a multi-cellular organism, such as a non-human animal.

As used herein, the singular forms "a," "an," and "the" include plural references unless the context clearly dictates otherwise.

As used herein, the terms "including," "comprising," "containing," or "having" and variations thereof are meant to encompass the items listed thereafter and equivalents thereof as well as additional subject matter unless otherwise noted.

As used herein, the phrases "in one embodiment," "in various embodiments," "in some embodiments," and the like are used repeatedly. Such phrases do not necessarily refer to the same embodiment, but they may unless the context dictates otherwise.

As used herein, the terms "and/or" or "/" means any one of the items, any combination of the items, or all of the items with which this term is associated.

As used herein, the word "substantially" does not exclude "completely," e.g., a composition which is "substantially free" from Y may be completely free from Y. Where necessary, the word "substantially" may be omitted from the definition of the invention.

As used herein, the term "each," when used in reference to a collection of items, is intended to identify an individual item in the collection but does not necessarily refer to every item in the collection. Exceptions can occur if explicit disclosure or context clearly dictates otherwise.

As used herein, the term "approximately" or "about," as applied to one or more values of interest, refers to a value that is similar to a stated reference value. In some embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). Unless indicated otherwise herein, the term "about" is intended to include values, e.g., weight percents, proximate to the recited range that are equivalent in terms of the functionality of the individual ingredient, the composition, or the embodiment.

As disclosed herein, a number of ranges of values are provided. It is understood that each intervening value, to the tenth of the unit of the lower limit, unless the context clearly dictates otherwise, between the upper and lower limits of that range is also specifically disclosed. Each smaller range between any stated value or intervening value in a stated range and any other stated or intervening value in that stated range is encompassed within the invention. The upper and lower limits of these smaller ranges may independently be included or excluded in the range, and each range where either, neither, or both limits are included in the smaller ranges is also encompassed within the invention, subject to any specifically excluded limit in the stated range. Where the stated range includes one or both of the limits, ranges excluding either or both of those included limits are also included in the invention.

The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

All methods described herein are performed in any suitable order unless otherwise indicated herein or otherwise clearly contradicted by context. In regard to any of the methods provided, the steps of the method may occur simultaneously or sequentially. When the steps of the method occur sequentially, the steps may occur in any order, unless noted otherwise. In cases in which a method comprises a combination of steps, each and every combination or sub-combination of the steps is encompassed within the scope of the disclosure, unless otherwise noted herein.

Each publication, patent application, patent, and other reference cited herein is incorporated by reference in its entirety to the extent that it is not inconsistent with the present disclosure. Publications disclosed herein are provided solely for their disclosure prior to the filing date of the present invention. Nothing herein is to be construed as an admission that the present invention is not entitled to antedate such publication by virtue of prior invention. Further, the dates of publication provided may be different from the actual publication dates, which may need to be independently confirmed.

It is understood that the examples and embodiments described herein are for illustrative purposes only and that various modifications or changes in light thereof will be suggested to persons skilled in the art and are to be included within the spirit and purview of this application and scope of the appended claims.

F. EXAMPLES

Example 1

This example describes the materials, methods, and instrumentation used in EXAMPLE 2.

Study participants. Study participants were recruited at the Rockefeller University Hospital in New York from April 1 through May 8, 2020. Eligible participants were adults aged 18-76 years who were either diagnosed with SARS-CoV-2 infection by RT-PCR and were free of symptoms of COVID-19 for at least 14 days (cases), or who were close contacts (e.g., household, co-workers, members of the same religious community) with someone who had been diagnosed with SARS-CoV-2 infection by RT-PCR and were free of symptoms suggestive of COVID-19 for at least 14 days (contacts). Exclusion criteria included the presence of symptoms suggestive of active SARS-CoV-2 infection, or hemoglobin <12 g/dL for males and <11 g/dL for females.

Most study participants were residents of the Greater New York City tri-state region and were enrolled sequentially according to eligibility criteria. Participants were first interviewed by phone to collect information on their clinical presentation and subsequently presented to the Rockefeller University Hospital for a single blood sample collection. Participants were asked to rate the highest severity of their symptoms on a numeric rating scale ranging from 0 to 10. The score was adapted from the pain scale chart, where 0 was the lack of symptoms, 4 were distressing symptoms (e.g., fatigue, myalgia, fever, cough, shortness of breath) that interfered with daily living activities, 7 were disabling symptoms that prevented the performance of daily living activities, and 10 were unimaginable/unspeakable discomfort (in this case, distress due to shortness of breath). All participants provided written informed consent before participation in the study, and the study was conducted in accordance with Good Clinical Practice, and clinical data collection and management was with software iRIS by iMedRIS. The study was performed in compliance with all relevant ethical regulations, and the protocol for human subject studies was approved by the Institutional Review Board (IRB) of the Rockefeller University.

Blood samples processing and storage. Peripheral Blood Mononuclear Cells (PBMCs) were obtained by gradient centrifugation and stored in liquid nitrogen in the presence of FCS and DMSO. Heparinized plasma and serum samples were aliquoted and stored at −20° C. or less. Prior to experiments, aliquots of plasma samples were heat-inactivated (56C for 1 hour) and then stored at 4C.

Cloning, expression, and purification of recombinant coronavirus proteins. Codon-optimized nucleotide sequences encoding the SARS-CoV-2 S ectodomain (residues 16-1206) and receptor-binding domain (RBD; residues 331-524) were synthesized and subcloned into the mammalian expression pTwist-CMV BetaGlobin vector by Twist Bioscience Technologies based on an early SARS-CoV-2 sequence isolate (GenBank MN985325.1). The SARS-CoV-2 RBD construct included an N-terminal human IL-2 signal peptide and dual C-terminal tags ((GGGGS)$_2$-HHHHHHHH (SEQ ID NO: 3233) (octa-histidine), and GLNDIFEAQKIEWHE (SEQ ID NO: 3234) (AviTag)). In addition, the corresponding S1$^B$ or receptor binding domains for SARS-CoV (residues 318-510; GenBank AAP13441.1), MERS-CoV (residues 367-588; GenBank JX869059.2), HCoV-NL63 (residues 481-614; GenBank AAS58177.1), HCoV-OC43 (residues 324-632; GenBank AAT84362.1), and HCoV-229E (residues 286-434; GenBank AAK32191.1) were synthesized with the same N- and C-terminal extensions as the SARS-CoV-2 RBD construct and subcloned into the mammalian expression pTwist-CMV BetaGlobin vector (Twist Bioscience Technologies). The SARS-CoV-2 S ectodomain was modified as previously described (Walls, A. C. et al. Cell 181, 281-292 e286 (2020).). Briefly, the S ectodomain construct included an N-terminal mu-phosphatase signal peptide, 2P stabilizing mutations (K986P and V987P), mutations to remove the S1/S2 furin cleavage site ($_{682}$RRAR$_{685}$ (SEQ ID NO: 3235) to GSAS (SEQ ID NO: 3236)), a C-terminal extension (IKGSG-RENLYFQG (SEQ ID NO: 3237) (TEV protease site), GGGSG-YIPEAPRDGQAYVRKDGEWVLLSTFL (SEQ ID NO: 3238) (foldon trimerization motif), G-HHHHHHHH (SEQ ID NO: 3239) (octa-histidine tag), and GLNDIFEAQKIEWHE (SEQ ID NO: 3234) (AviTag)). The SARS-CoV-2 S 2P ectodomain and RBD constructs were produced by transient transfection of 500 mL of Expi293F cells (Thermo Fisher) and purified from clarified transfected cell supernatants four days post-transfection using Ni$^{2+}$-NTA affinity chromatography (GE Life Sciences). Affinity-purified proteins were concentrated and further purified by size-exclusion chromatography (SEC) using a Superdex200 16/60 column (GE Life Sciences) running in 1×TBS (20 mM Tris-HCl pH 8.0, 150 mM NaCl, and 0.02% NaN3). Peak fractions were analyzed by SDS-PAGE, and fractions corresponding to soluble S 2P trimers or monomeric RBD proteins were pooled and stored at 4° C.

ELISAs. Validated ELISAs to evaluate antibodies binding to SARS-CoV-2 RBD and trimeric spike proteins, and to SARS-CoV RBD, were performed by coating of high binding 96 half well plates (Corning #3690) with 50 µL per well of a 1 µg/mL protein solution in PBS overnight at 4° C. (Amanat, F. et al. Nat Med, doi:10.1038/s41591-020-0913-5 (2020); Grifoni, A. et al. Cell, doi:10.1016/j.cell.2020.05.015 (2020)). Plates were washed 6 times with washing buffer (1×PBS with 0.05% Tween 20 (Sigma-Aldrich)) and incubated with 170 µL per well blocking buffer (1×PBS with 2% BSA and 0.05% Tween20 (Sigma)) for 1 hour at room temperature (RT). Immediately after blocking, monoclonal antibodies or plasma samples were added in PBS and incubated for 1 hr at RT. Plasma samples were assayed at a 1:200 starting dilution and seven additional 3-fold serial dilutions. Monoclonal antibodies were tested at 10 µg/ml starting concentration and 10 additional 4-fold serial dilutions. Plates were washed 6 times with washing buffer and then incubated with anti-human IgG or IgM secondary antibody conjugated to horseradish peroxidase (HRP) (Jackson Immuno Research 109-036-088 and 109-035-129) in blocking buffer at a 1:5000 dilution. Plates were developed by addition of the HRP substrate, TMB (ThermoFisher) for 10 minutes, then the developing reaction was stopped by adding 50 µl 1M $H_2SO_4$ and absorbance was measured at 450 nm with an ELISA microplate reader (FluoStar Omega, BMG Labtech) with Omega and Omega MARS software for analysis. For plasma samples, a positive control (plasma from patient COV21, diluted 200-fold in PBS) and negative control historical plasma samples were added in duplicate to every assay plate for validation. The average of its signal was used for normalization of all the other values on the same plate with Excel software prior to calculating the area under the curve using Prism 8 (GraphPad). For monoclonal antibodies, the half-maximal effective concentration ($EC_{50}$) was determined using 4-parameter nonlinear regression (GraphPad Prism).

$293T_{ACE2}$ cells. For constitutive expression of ACE2 in 293T cells, a cDNA encoding ACE2, carrying two inactivating mutations in the catalytic site (H374N & H378N), was inserted into CSIB 3' to the SFFV promoter (Kane, M. et al. Cell Host Microbe 20, 392-405 (2016).). $293T_{ACE2}$ cells were generated by transduction with CSIB based virus followed by selection with 5 µg/ml Blasticidin.

SARS-CoV-2 and SARS-CoV pseudotyped reporter viruses. A plasmid expressing a C-terminally truncated SARS-CoV-2 S protein (pSARS-CoV2-$S_{trunc}$) was generated by insertion of a human-codon optimized cDNA encoding SARS-CoV-2 S lacking the C-terminal 19 codons (GENEART) into pCR3.1. The S ORF was taken from "Wuhan seafood market pneumonia virus isolate Wuhan-Hu-1" (NC_045512). For expression of full-length SARS-CoV S protein, "Human SARS coronavirus Spike glycoprotein Gene ORF cDNA clone expression plasmid (Codon Optimized)" (here referred to as pSARS—CoV-S) was obtained from SinoBiological (Cat: VG40150-G-N). An env-inactivated HIV-1 reporter construct (pNL4-3ΔFnv-nanoluc) was generated from pNL4-3 by introducing a 940 bp deletion 3' to the vpu stop-codon, resulting in a frameshift in env (Adachi, A. et al. J Virol 59, 284-291 (1986).). The human codon-optimized nanoluc Luciferase reporter gene (Nluc, Promega) was inserted in place of nucleotides 1-100 of the nef-gene. To generate pseudotyped viral stocks, 293T cells were transfected with pNL4-3ΔEnv-nanoluc and pSARS-CoV2-$S_{trunc}$ or pSARS—CoV-S using polyethyleneimine. Co-transfection of pNL4-3ΔFnv-nanoluc and S-expression plasmids leads to production of HIV-1-based virions carrying either the SARS-CoV-2 or SARS-CoV spike protein on the surface. Eight hours after transfection, cells were washed twice with PBS, and fresh media was added. Supernatants containing virions were harvested 48 hours post transfection, filtered, and stored at −80° C. Infectivity of virions was determined by titration on $293T_{ACE2}$ cells. See also https://www.biorxiv.org/content/10.1101/2020.06.08.140871v1.

Pseudotyped virus neutralization assay. Five-fold serially diluted plasma from COVID-19 convalescent individuals and healthy donors or four-fold serially diluted monoclonal antibodies were incubated with the SARS-CoV-2 or SARS-CoV pseudotyped virus for 1 hour at 37° C. degrees. The mixture was subsequently incubated with $293T_{ACE2}$ cells for 48 hours, after which cells were washed twice with PBS and lysed with Luciferase Cell Culture Lysis 5× reagent (Promega). Nanoluc Luciferase activity in lysates was measured using the Nano-Glo Luciferase Assay System (Promega) with Modulus II Microplate Reader User interface (TURNER BioSystems). Relative luminescence units obtained were normalized to those derived from cells infected with SARS-CoV-2 or SARS-CoV pseudotyped virus in the absence of plasma or monoclonal antibodies. The half-maximal inhibitory concentration for plasma ($NT_{50}$) or monoclonal antibodies ($IC_{50}$) was determined using 4-parameter nonlinear regression (GraphPad Prism).

Cell lines, virus, and virus titration. VeroE6 kidney epithelial cells (*Chlorocebus sabaeus*; ATCC) and Huh-7.5 hepatoma cells (*H. sapiens*; Dr. Charles Rice, Laboratory of Virology and Infectious Disease, The Rockefeller University) were cultured in Dulbecco's Modified Eagle Medium (DMEM) supplemented with 1% nonessential amino acids (NEAA) and 10% fetal bovine serum (FBS) at 37° C. and 5% $CO_2$. All cell lines have been tested negative for contamination with mycoplasma and were obtained from the ATCC (with the exception for Huh-7.5). SARS-CoV-2, strain USA-WA1/2020, was obtained from BEI Resources and amplified in VeroE6 cells at 33° C. Viral titers were measured on Huh-7.5 cells by standard plaque assay (PA). Briefly, 500 µL of serial 10-fold virus dilutions in Opti-MEM were used to infect 400,000 cells seeded the day prior in a 6-well plate format. After 90 min adsorption, the virus inoculum was removed, and cells were overlayed with DMEM containing 10% FBS with 1.2% microcrystalline cellulose (Avicel). Cells were incubated for five days at 33° C., followed by fixation with 3.5% formaldehyde and crystal violet staining for plaque enumeration. All experiments were performed in a biosafety level 3 laboratory.

Microscopy-based neutralization assay of authentic SARS-CoV-2. The day prior to infection, VeroE6 cells were seeded at 12,500 cells/well into 96-well plates. Antibodies were serially diluted in BA-1, mixed with a constant amount of SARS-CoV-2 (grown in VeroE6), and incubated for 60 min at 37° C. The antibody-virus-mix was then directly applied to VeroE6 cells (MOI of ~0.1 PFU/cell). Cells were fixed 18 hours post infection by adding an equal volume of 7% formaldehyde to the wells, followed by permeabilization with 0.1% Triton X-100 for 10 min. After extensive washing, cells were incubated for 1 hour at room temperature with blocking solution of 5% goat serum in PBS (catalog no. 005-000-121; Jackson ImmunoResearch). A rabbit polyclonal anti-SARS-CoV-2 nucleocapsid antibody (catalog no. GTX135357; GeneTex) was added to the cells at 1:500 dilution in blocking solution and incubated at 4° C. overnight. A goat anti-rabbit AlexaFluor 594 (catalog no. A-11012; Life Technologies) at a dilution of 1:2,000 was used as a secondary antibody. Nuclei were stained with Hoechst 33342 (catalog no. 62249; Thermo Scientific) at a 1:1,000 dilution. Images were acquired with a fluorescence microscope and analyzed using ImageXpress Micro XLS and MetaXpress software (Molecular Devices, Sunnyvale, Calif.). All statistical analyses were done using Prism 8 software (GraphPad).

Biotinylation of viral protein for use in flow cytometry. Purified and Avi-tagged SARS-CoV-2 RBD was biotinylated using the Biotin-Protein Ligase-BIRA kit according to manufacturer's instructions (Avidity). Ovalbumin (Sigma, A5503-1G) was biotinylated using the EZ-Link Sulfo-NHS-LC-Biotinylation kit according to the manufacturer's instructions (Thermo Scientific). Biotinylated Ovalbumin was conjugated to streptavidin-BV711 (BD biosciences, 563262) and RBD to streptavidin-PE (BD biosciences, 554061) and streptavidin-Alexa Fluor 647 (AF647, Biolegend, 405237) respectively (Wang, Z. et al. J Immunol Methods 478, 112734, (2020)).

Single cell sorting by flow cytometry. PBMCs were enriched for B cells by negative selection using a pan B cell isolation kit according to the manufacturer's instructions (Miltenyi Biotec, 130-101-638). The enriched B cells were incubated in FACS buffer (1×Phosphate-buffered Saline (PBS), 2% calf serum, 1 mM EDTA) with the following anti-human antibodies (all at 1:200 dilution): anti-CD20-PECy7 (BD Biosciences, 335793), anti-CD3-APC-eFluro 780 (Invitrogen, 47-0037-41), anti-CD8-APC-eFluro 780 (Invitrogen, 47-0086-42), anti-CD16-APC-eFluro 780 (Invitrogen, 47-0168-41), anti-CD14-APC-eFluro 780 (Invitrogen, 47-0149-42), as well as Zombie NIR (BioLegend, 423105), and fluorophore-labeled RBD and Ovalbumin for 30 minutes on ice (Wang, Z. et al. J Immunol Methods 478, 112734 (2020).). Single $CD3^-CD8^-CD16^-CD20^+Ova^-RBD-PE^+RBD-AF647^+$ B cells were sorted into individual wells of 96-well plates containing 4 µl of lysis buffer (0.5×PBS, 10 mM DTT, 3000 units/mL RNasin Ribonuclease Inhibitors (Promega, N2615) per well using a FACS Aria III and FACSDiva software (Becton Dickinson) for acquisition and FlowJo for analysis. The sorted cells were frozen on dry ice, and then stored at −80° C. or immediately used for subsequent RNA reverse transcription. Although cells were not stained for IgG expression, they are memory B cells based on the fact that they are $CD20^+$ (a marker absent in plasmablasts) and they express IgG (since antibodies were amplified from these cells using IgG-specific primers).

Antibody sequencing, cloning, and expression. Antibodies were identified and sequenced as described previously (Robbiani, D. F. et al. Cell 169, 597-609 e511 (2017); Tiller, T. et al. J Immunol Methods 329, 112-124 (2008); von Boehmer, L. et al. Nat Protoc 11, 1908-1923 (2016)). Briefly, RNA from single cells was reverse-transcribed (SuperScript III Reverse Transcriptase, Invitrogen, 18080-044) and the cDNA stored at −20° C. or used for subsequent amplification of the variable IGH, IGL and IGK genes by nested PCR and Sanger sequencing (Tiller, T. et al. J Immunol Methods 329, 112-124 (2008)). Anti-Zika virus monoclonal antibody Z021 (Robbiani, D. F. et al. Cell 169, 597-609 e511 (2017)) was used as isotype control. Sequence analysis was with MacVector. Amplicons from the first PCR reaction were used as templates for Sequence- and Ligation-Independent Cloning (SLIC) into antibody expression vectors. Recombinant monoclonal antibodies and Fabs were produced and purified as previously described (Klein, F. et al. J Exp Med 211, 2361-2372 (2014); Schoofs, T. et al. Immunity 50, 1513-1529 (2019)).

Biolayer interferometry. BLI assays were performed on the Octet Red instrument (ForteBio) at 30° C. with shaking at 1,000 r.p.m. Epitope binding assays were performed with protein A biosensor (ForteBio 18-5010), following the manufacturer's protocol "classical sandwich assay." (1) Sensor check: sensors immersed 30 sec in buffer alone (buffer ForteBio 18-1105). (2) Capture $1^{st}$ Ab: sensors immersed 10 min with Ab1 at 40 µg/mL. (3) Baseline: sensors immersed 30 sec in buffer alone. (4) Blocking: sensors immersed 5 min with IgG isotype control at 50 µg/mL. (6) Antigen association: sensors immersed 5 min with RBD at 100 µg/mL. (7) Baseline: sensors immersed 30 sec in buffer alone. (8) Association Ab2: sensors immersed 5 min with Ab2 at 40 µg/mL. Curve fitting was performed using the Fortebio Octet Data analysis software (ForteBio).

Computational analyses of antibody sequences. Antibody sequences were trimmed based on quality and annotated using Igblastn v1.14.0 (Ye, J., et al. IgBLAST: an immunoglobulin variable domain sequence analysis tool. Nucleic Acids Res 41, W34-40 (2013)) with IMGT domain delineation system. Annotation was performed systematically using Change-0 toolkit v.0.4.5 (Gupta, N. T. et al. Bioinformatics 31, 3356-3358 (2015).). Heavy and light chains derived from the same cell were paired, and clonotypes were assigned based on their V and J genes using in-house R and Perl scripts (FIGS. 5B and 5C). All scripts and the data used to process antibody sequences are publicly available on GitHub (https://github.com/stratust/igpipeline).

Figure 13:
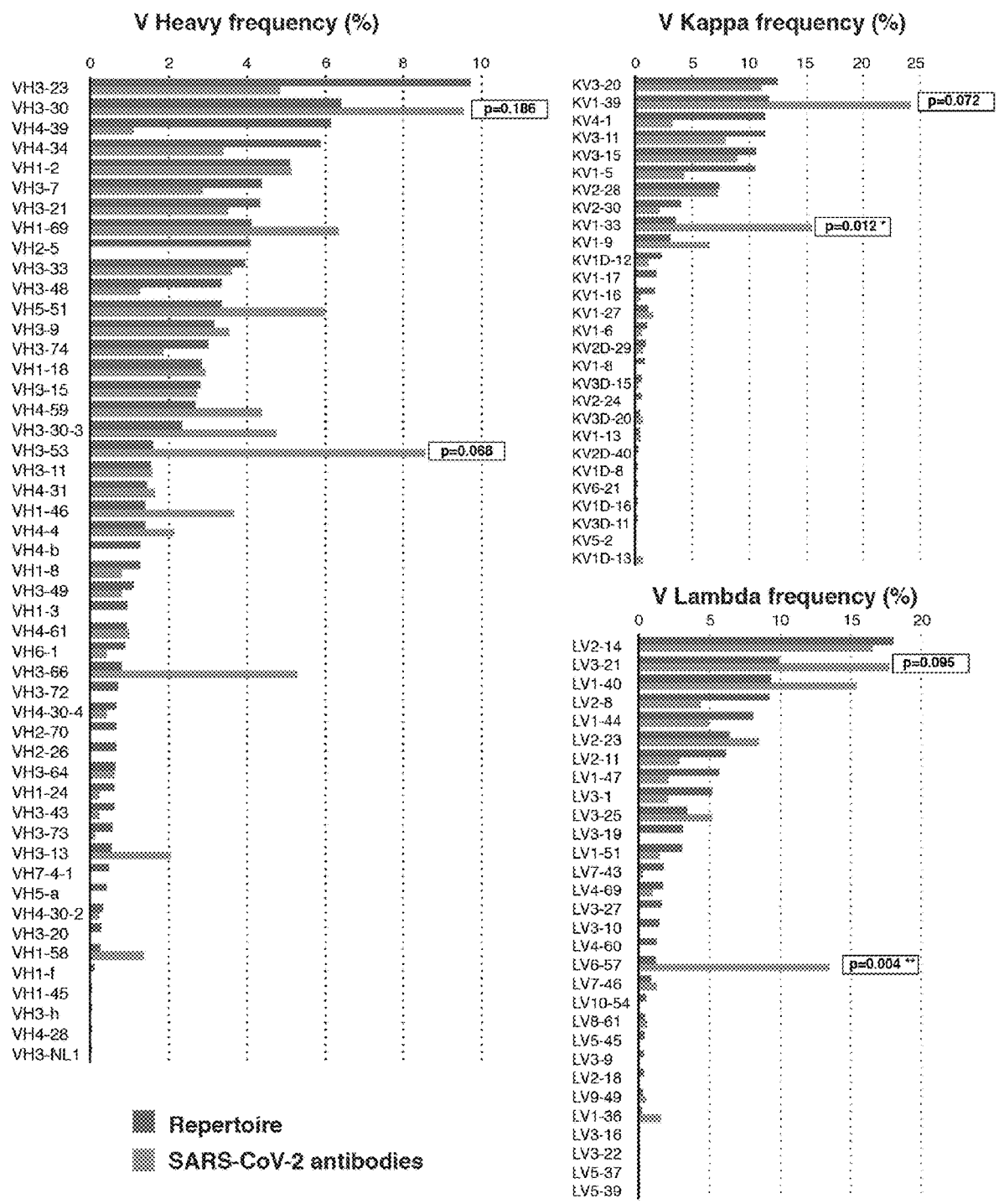
FIG. 13 shows frequency distributions of human V genes. The two-tailed t test with unequal variance was used to compare the frequency distributions of human V genes of anti-SARS-CoV-2 antibodies from this study to Sequence Read Archive SRP010970 (Rubelt, F. et al. PLoS One).

The frequency distributions of human V genes in anti-SARS-CoV-2 antibodies from this study were compared to Sequence Read Archive SRP010970 (Rubelt, F. et al. PLoS One 7, e49774 (2012).). The V(D)J assignments were done using IMGT/High V-Quest, and the frequencies of heavy and light chain V genes were calculated for 14 and 13 individuals, respectively, using sequences with unique CDR3 s. The two-tailed t test with unequal variances was used to determine statistical significance (FIG. 13).

Figure 14:
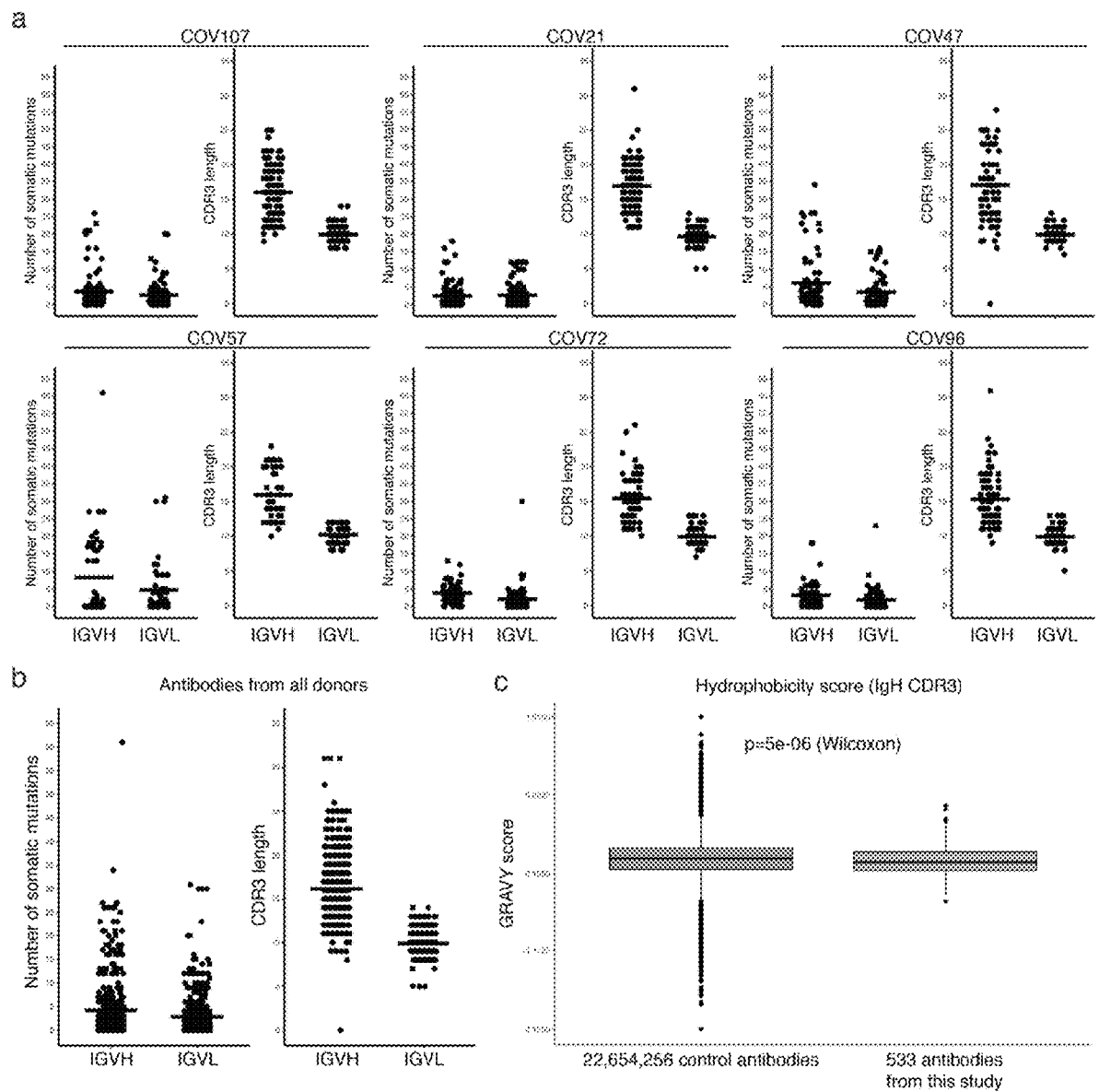
FIGS. 14A, 14B, and 14C (collectively "FIG. 14") show the analysis of antibody somatic hypermutation and CDR3 length.

Nucleotide somatic hypermutation and CDR3 length were determined using in-house R and Perl scripts. For somatic hypermutations, IGHV and IGLV nucleotide sequences were aligned against their closest germlines using Igblastn, and the number of differences was considered nucleotide mutations. The average mutations for V genes were calculated by dividing the sum of all nucleotide mutations across all patients by the number of sequences used for the analysis. To calculate the GRAVY scores of hydrophobicity (Kyte, J. & Doolittle, R. F. J Mol Biol 157, 105-132 (1982).) we used Guy H. R. Hydrophobicity scale based on free energy of transfer (kcal/mole) (Guy, H. R. Biophys J 47, 61-70 (1985).) implemented by the R package Peptides available in the Comprehensive R Archive Network repository (https://journal.r-project.org/archive/2015/RJ-2015-001/RJ-2015-001.pdf). We used 533 heavy chain CDR3 amino acid sequences from this study (sequence COV047_P4_IgG_51-P1369 lacks CDR3 amino acid sequence) and 22,654,256 IGH CDR3 sequences from the public database of memory B-cell receptor sequences (DeWitt, W. S. et al. PLoS One 11, e0160853 (2016).). The Shapiro-Wilk test was used to determine whether the GRAVY scores are normally distributed. The GRAVY scores from all 533 IGH CDR3 amino acid sequences from this study were used to perform the test, and 5000 GRAVY scores of the sequences from the public database were randomly selected. The Shapiro-Wilk p-values were $6.896 \times 10^{-3}$ and $2.217 \times 10'$ for sequences from this study and the public database, respectively, indicating the data are not normally distributed. Therefore, we used the Wilcoxon non-parametric test to compare the samples, which indicated a difference in hydrophobicity distribution ($p=5 \times 10'$; FIG. 14).

Negative-stain EM Data Collection and Processing. Purified Fabs (C002, C119, and C121) were complexed with SARS-CoV-2 S trimer at a 2-fold molar excess for 1 min and diluted to 40 µg/mL in TBS immediately before adding 3 µL to a freshly-glow discharged ultrathin, 400 mesh carbon-coated copper grid (Ted Pella, Inc.). Samples were blotted after a 1 min incubation period and stained with 1% uranyl formate for an additional minute before imaging. Micrographs were recorded on a Thermo Fisher Talos Arctica transmission electron microscope operating at 200 keV using a K3 direct electron detector (Gatan, Inc) and SerialEM automated image acquisition software (Mastronarde, D. N. J Struct Biol 152, 36-51 (2005).). Images were acquired at a nominal magnification of 28,000× (1.44 Å/pixel size) and a −1.5 to −2.0 µm defocus range. Images were processed in cryoSPARC, and reference-free particle picking was completed using a gaussian blob picker (Punjani, A., et al. Nat Methods 14, 290-296 (2017).). Reference-free 2D class averages and ab initio volumes were generated in cryoSPARC, and subsequently 3D-classified to identify classes of S-Fab complexes, that were then homogenously refined. Figures were prepared using UCSF Chimera (Goddard, T. D., et al. J Struct Biol 157, 281-287 (2007).). The resolutions of the final single particle reconstructions were ~17-20 Å calculated using a gold-standard FSC (0.143 cutoff) and ~24-28 Å using a 0.5 cutoff.

Example 2

During the COVID-19 pandemic, SARS-CoV-2 infected millions of people and claimed hundreds of thousands of lives. Virus entry into cells depends on the receptor binding domain (RBD) of the SARS-CoV-2 spike protein (S). Although there is no vaccine, it is likely that antibodies will be essential for protection. However, little is known about the human antibody response to SARS-CoV-2 (Graham, R. L., et al. Nat Rev Microbiol 11, 836-848 (2013); Gralinski, L. E. & Baric, R. S. J Pathol 235, 185-195 (2015); Hoffmann, M. et al. Cell 181, 271-280 e278 (2020); Walls, A. C. et al. Cell 181, 281-292 (2020); Jiang, S., et al. Trends Immunol (2020).). This disclosure reports on 149 COVID-19 convalescent individuals. Plasmas collected an average of 39 days after the onset of symptoms had variable half-maximal pseudovirus neutralizing titers: less than 1:50 in 33% and below 1:1000 in 79%, while only 1% showed titers >1:5000. Antibody sequencing revealed expanded clones of RBD-specific memory B cells expressing closely related antibodies in different individuals. Despite low plasma titers, antibodies to three distinct epitopes on RBD neutralized at half-maximal inhibitory concentrations (IC$_{50}$s) as low as single-digit ng/mL. Thus, most convalescent plasmas obtained from individuals who recover from COVID-19 do not contain high levels of neutralizing activity. Nevertheless, rare but recurring RBD-specific antibodies with potent antiviral activity were found in all individuals tested, suggesting that a vaccine designed to elicit such antibodies could be broadly effective.

Between Apr. 1 and May 8, 2020, 157 eligible participants enrolled in the study. Of these, 111 (70.7%) were individuals diagnosed with SARS-CoV-2 infection by RT-PCR (cases), and 46 (29.3%) were close contacts of individuals diagnosed with SARS-CoV-2 infection (contacts). While inclusion criteria allowed for enrollment of asymptomatic participants, 8 contacts that did not develop symptoms were excluded from further analyses. The 149 cases and contacts were free of symptoms suggestive of COVID-19 for at least 14 days at the time of sample collection. Participant demographics and clinical characteristics are shown in Tables 2 and 3 and FIG. 7A. Only one individual who tested positive for SARS-CoV-2 infection by RT-PCR remained asymptomatic. The other 148 participants reported symptoms suggestive of COVID-19 with an average onset of approximately 39 days (range 17 to 67 days) before sample collection. In this cohort, symptoms lasted for an average of 12 days (0-35 days), and 11 (7%) of the participants were hospitalized. The most common symptoms were fever (83.9%), fatigue (71.1%), cough (62.4%), and myalgia (61.7%), while baseline comorbidities were infrequent (10.7%) (Tables 2 and 3). There were no significant differences in duration or severity (see Methods) of symptoms, or in time from onset of symptoms to sample collection between genders or between cases and contacts. There was no age difference between females and males in our cohort (FIG. 7).

Plasma samples were tested for binding to the SARS-CoV-2 RBD and trimeric spike (S) proteins by a validated ELISA using anti-IgG or -IgM secondary antibodies for detection (FIG. 7, Table 2, FIGS. 8 and 9) (Amanat, F. et al. Nat Med (2020); Grifoni, A. et al. Cell (2020).). Eight independent negative controls and the positive control plasma sample from participant 21 (COV21) were included for normalization of the area under the curve in all experiments (AUC). Overall, 78% and 70% of the plasma samples tested showed anti-RBD and anti-S IgG AUCs that were at least 2 standard deviations above the control (FIGS. 7A and 7B). In contrast, only 15% and 34% of the plasma samples showed IgM responses to anti-RBD and anti-S that were at least 2 standard deviations above control, respectively (FIGS. 7C and 7D). There was no positive correlation between anti-RBD or -S IgG or IgM levels and duration of symptoms or the timing of sample collection relative to the onset of symptoms (FIG. 3E and FIGS. 9A-9C and 9G-9J). On the contrary, as might be expected, anti-RBD IgM titers were negatively correlated with duration of symptoms and the timing of sample collection (FIG. 3E and FIG. 9H). Anti-RBD IgG levels were modestly correlated to age and the severity of symptoms including hospitalization (FIGS. 3F-3G and FIG. 9K). Interestingly, females had lower anti-RBD and -S IgG titers than males (FIG. 3H and FIG. 8F).

To measure the neutralizing activity in convalescent plasmas, we used HIV-1-based virions carrying a nanoluc luciferase reporter that was pseudotyped with the SARS-CoV-2 spike (SARS-CoV-2 pseudovirus, see Methods, FIG. 4 and FIG. 10). Negative (historical) and positive (COV21) controls were included in all experiments. The overall level of neutralizing activity in the cohort, as measured by the half-maximal neutralizing titer (NT$_{50}$) was generally low, with 33% less than 50 and 79% below 1,000 (FIGS. 4A and 4B). The geometric mean NT$_{50}$ was 121 (arithmetic mean=714), and only 2 individuals reached NT$_{50}$s above 5,000 (FIGS. 4A and 4B and Table 2).

Notably, levels of anti-RBD- and -S IgG antibodies correlated strongly with NT$_{50}$ (FIGS. 4C and 4D). The neutralizing activity also correlated with age, duration of symptoms, and symptom severity (FIG. 11). Consistent with this observation, hospitalized individuals with longer symptom duration showed slightly higher average levels of neutralizing activity than non-hospitalized individuals (p=0.0495, FIG. 4E). Finally, a significant difference in neutralizing activity between males and females (p=0.0031, FIG. 4F) was observed. The difference between males and females was consistent with higher anti-RBD and -S IgG titers in males, and could not be attributed to age, severity, timing of sample collection relative to the onset of symptoms or duration of symptoms (FIG. 3H and FIGS. 8A-8D and 8F).

Figure 12:
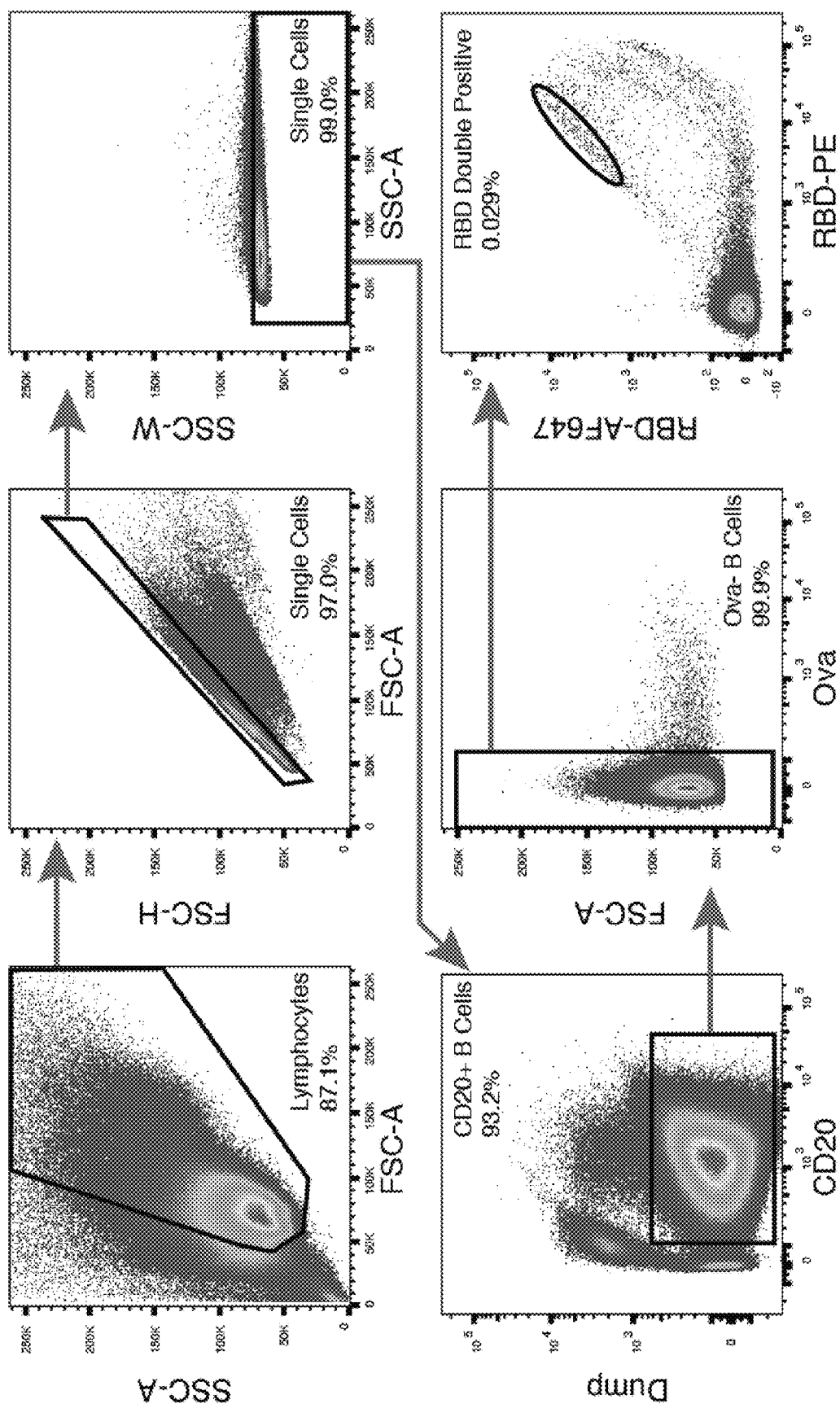
FIG. 12 shows the results of flow cytometry and gating strategy used for cell sorting. Gating was on singlets that were $CD20^+$ and $CD3^-CD8^-CD16^-Ova^-$. Sorted cells were $RBD-PE^+$ and $RBD-AF647^+$.

To determine the nature of the antibodies elicited by SARS-CoV-2 infection, flow cytometry was used to isolate individual B lymphocytes with receptors that bound to RBD from the blood of 6 selected individuals, including the 2 top and 4 high to intermediate neutralizers (FIG. 5). The frequency of antigen-specific B cells, identified by their ability to bind to both Phycoerythrin (PE)- and AF647-labeled RBD, ranged from 0.07 to 0.005% of all circulating B cells in COVID-19 convalescents but they were undetectable in pre-COVID-19 controls (FIG. 5A and FIG. 12). 534 paired IgG heavy and light chain (IGH and IGL) sequences were obtained by reverse transcription and subsequent PCR from individual RBD-binding B cells from the 6 convalescent individuals (see Methods and Tables 4-5 and 7-14). When compared to the human antibody repertoire, several IGHV and IGLV genes were significantly over-represented (FIG. 13). The average number of V genes nucleotide mutations for IGH and IGL was 4.2 and 2.8, respectively (FIG. 14), which is lower than in antibodies cloned from individuals suffering from chronic infections such as Hepatitis B or HIV-1, and similar to antibodies derived from primary malaria infection or non-antigen-enriched circulating IgG memory cells (Scheid, J. F. et al. Nature 458, 636-640 (2009); Tiller, T. et al. Immunity 26, 205-213 (2007); Murugan, R. et al. Sci Immunol 3 (2018); Wang, Q. et al. Cell Host Microbe, doi:10.1016/j.chom.2020.05.010 (2020) .). Among other antibody features, IGH CDR3 length was indistinguishable from the reported norm, and hydrophobicity was below average (FIG. 14) (Briney, B., et al. Nature 566, 393-397 (2019).).

As is the case with other human pathogens, there were expanded clones of viral antigen binding B cells in all COVID-19 individuals tested (see Methods and FIGS. 5B and 5C). Overall, 32.2% of the recovered IGH and IGL sequences were from clonally expanded B cells (range 21.8-57.4% across individuals, FIG. 5B). Antibodies that shared specific combinations of IGHV and IGLV genes in different individuals comprised 14% of all the clonal sequences (colored pie slices in FIGS. 5B and 5C). Remarkably, the amino acid sequences of some antibodies found in different individuals were nearly identical (FIGS. 5D and 5E). For example, antibodies expressed by clonally expanded B cells with IGHV1-58/IGKV3-20 and IGHV3-30-3/IGKV1-39 found repeatedly in different individuals had amino acid sequence identities of up to 99% and 92%, respectively (FIG. 5D and Table 4). It was concluded that the IgG memory response to the SARS-CoV-2 RBD is rich in recurrent and clonally expanded antibody sequences.

Figure 15:
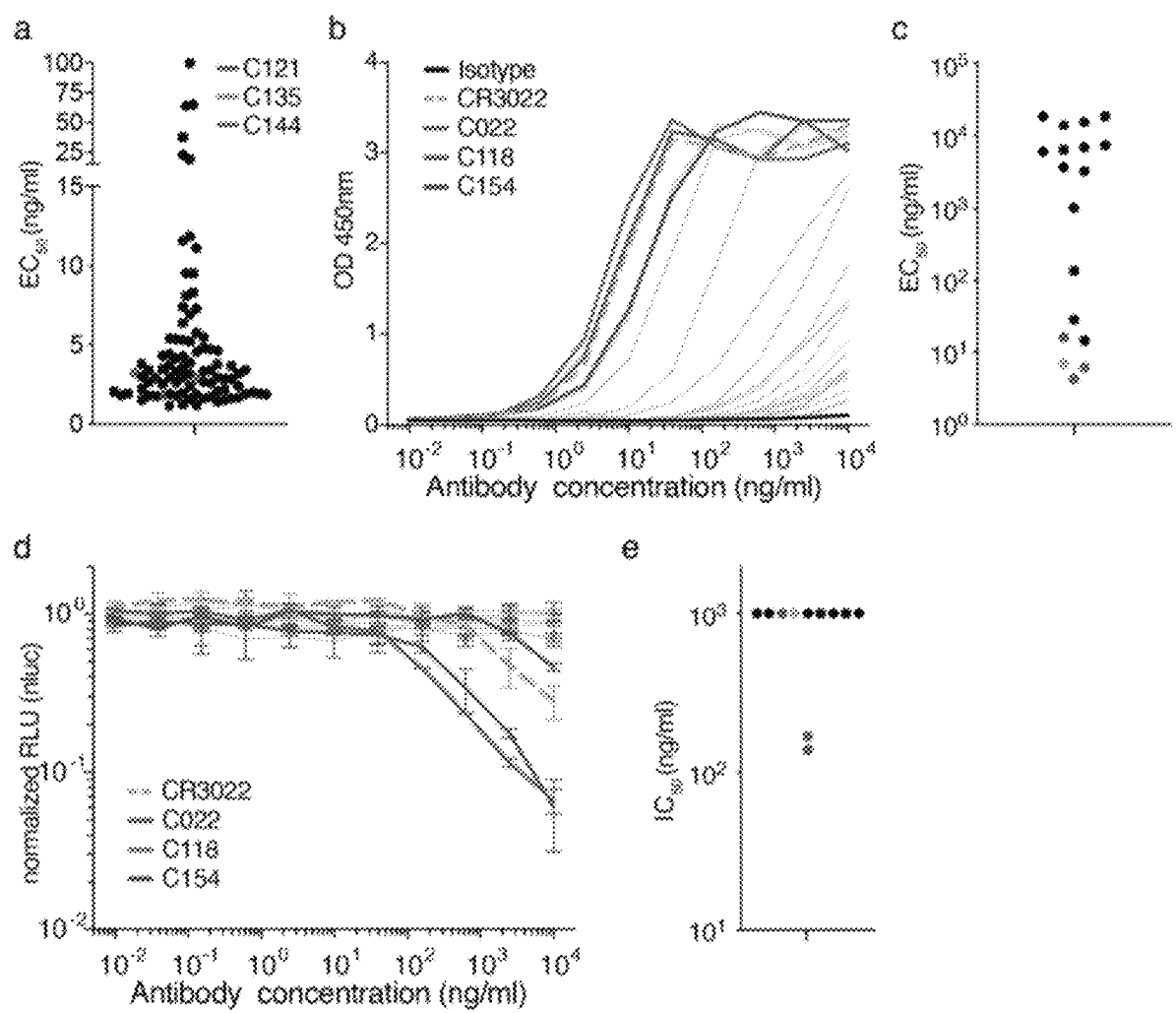
FIGS. 15A, 15B, 15C, 15D, and 15E (collectively "FIG. 15") show Binding of the monoclonal antibodies to the RBD of SARS-CoV-2 and cross-reactivity to SARS-CoV.
Figure 16:
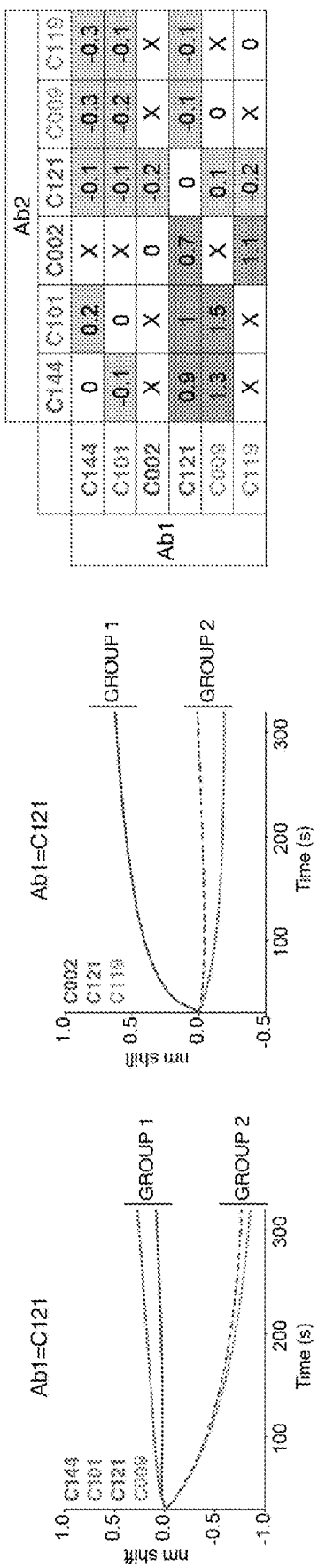
FIG. 16 shows the results of the biolayer interferometry experiment that depicts binding of antibodies C144, C101, C002, C121, C009, C119. Graphs show secondary antibody binding to preformed C121 IgG-RBD complexes. The table displays the shift in nanometers after second antibody (Ab2) binding to the antigen in the presence of the first antibody (Ab1). Values are normalized by the subtraction of the autologous antibody control.
Figures 30A, 30B:
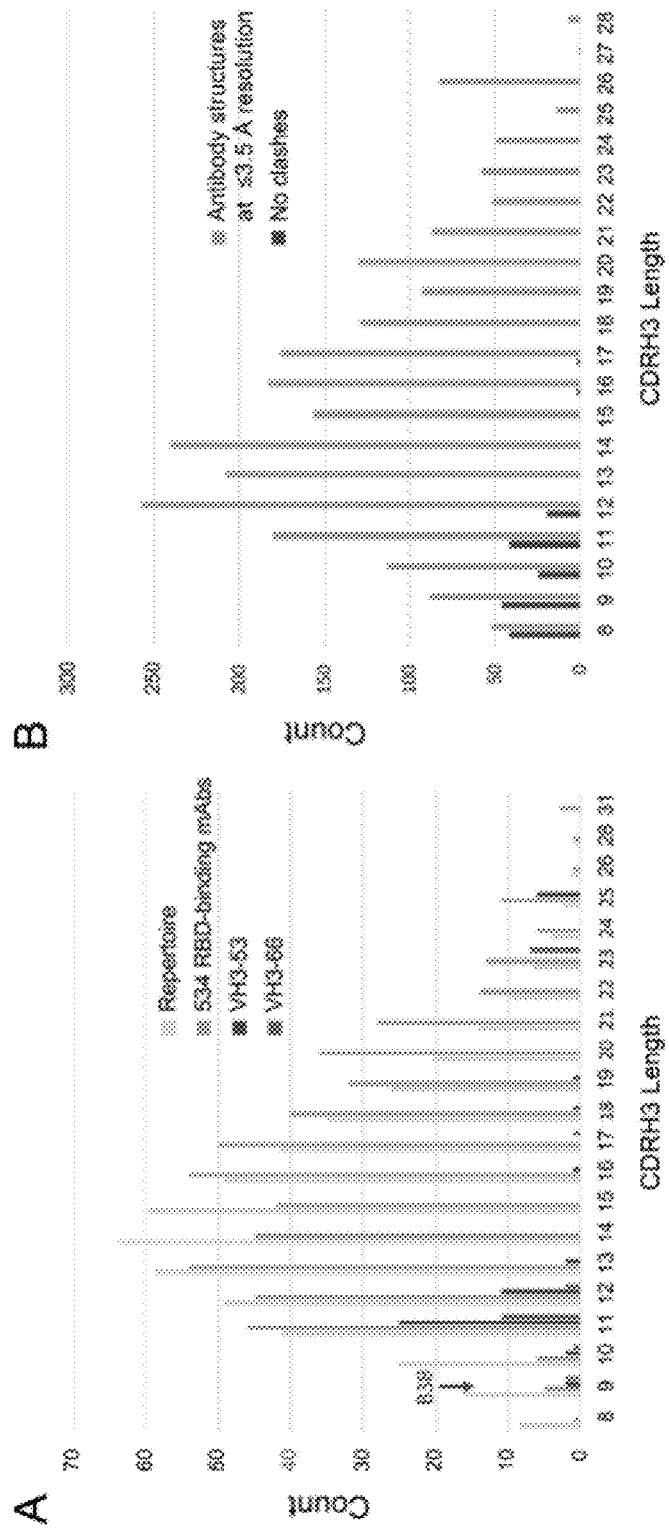
FIGS. 30A and 30B (collectively "FIG. 30") show CDRH3 length distributions (related to FIG. 21).
Figures 31A, 31B:
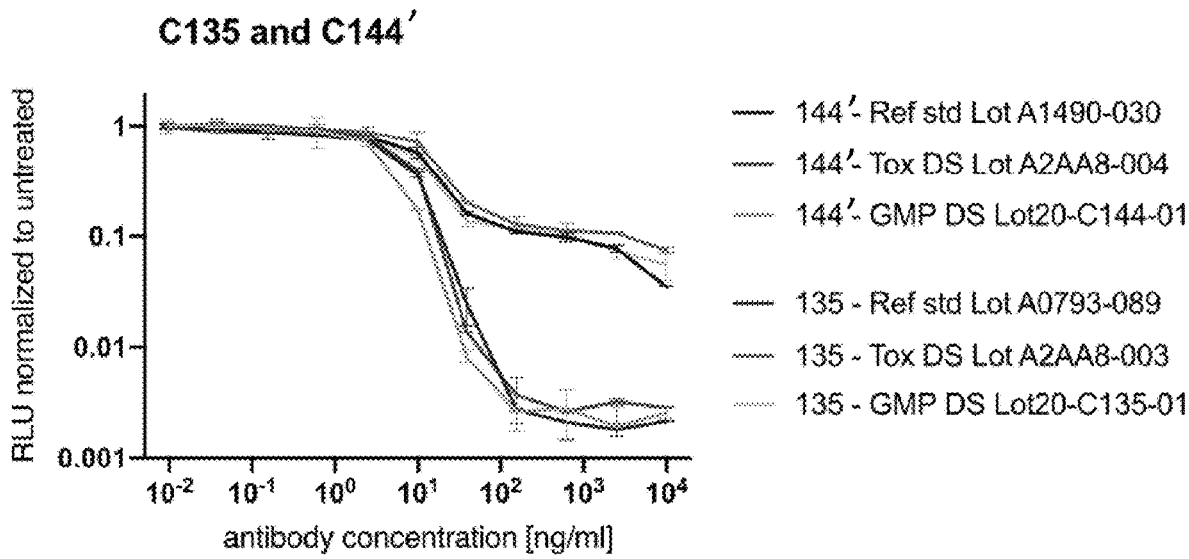
FIGS. 31A, 31B, 31C, and 31D are a set of diagrams showing SARS-CoV-2 pseudovirus neutralization of C135 and C144'.
Figures 31C, 31D:
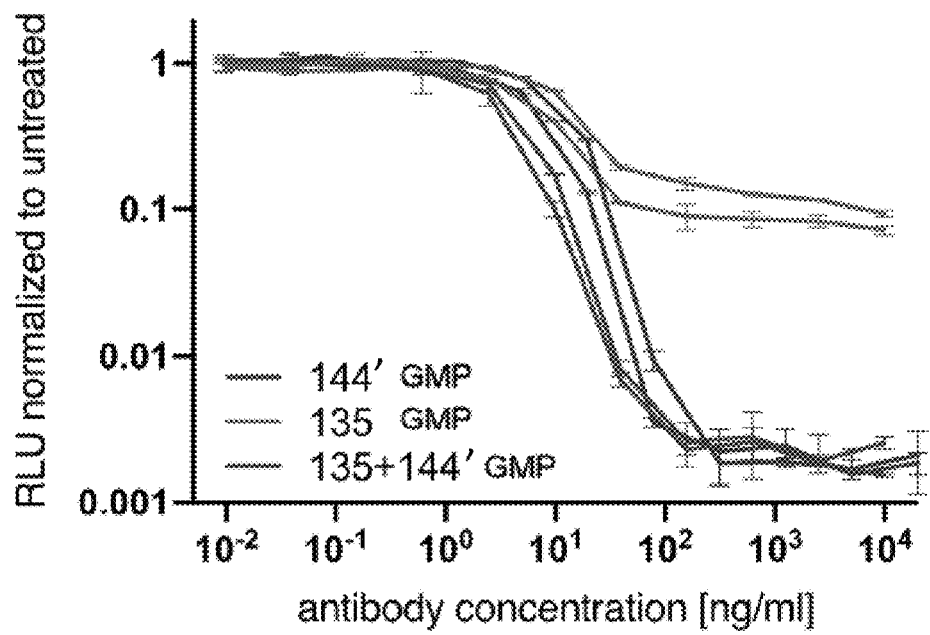

To examine the binding properties of anti-SARS-CoV-2 antibodies, 94 representative antibodies, 67 from clones and 27 from singlets (Tables 4 and 5), were expressed. ELISA assays showed that 95% (89 out of 94) of the antibodies tested including clonal and unique sequences bound to the SARS-CoV-2 RBD with an average half-maximal effective concentration ($EC_{50}$) of 6.9 ng/mL (FIG. 6A and FIG. 15A). A fraction of these (7 out of 77 that were tested, or 9%) cross-reacted with the RBD of SARS-CoV with $EC_{50}$s below 1 mg/mL (FIGS. 15B and 15C). No significant cross-reactivity was noted to the RBDs of MERS, HCoV-OC43, HCoV-229E or HCoV-NL63.

To determine whether the monoclonal antibodies have neutralizing activity, we tested them against the SARS-CoV-2 pseudovirus (FIG. 6 and Table 6). Among 89 RBD binding antibodies tested, it was found 52 that neutralized SARS-CoV-2 pseudovirus with nanogram per milliliter half-maximal inhibitory concentrations ($IC_{50}$s) ranging from 3 to 709 (FIGS. 6B, 6C, and 6E; Table 6). A subset of the most potent of these antibodies was also tested against authentic SARS-CoV-2 and neutralized with $IC_{50}$s of less than 5 ng/ml (FIGS. 6D and 6E). Only two of the antibodies which cross-reacted with the RBD of SARS-CoV showed significant neutralizing activity against SARS-CoV pseudovirus (FIGS. 15D and 15E).

Potent neutralizing antibodies were found in individuals irrespective of their plasma $NT_{50}$s. For example, C121, C144, and C135 with $IC_{50}$s of 1.64, 2.55 and 2.98 ng/mL against authentic SARS-CoV-2, respectively, were obtained from individuals COV107, COV47, and COV72 whose plasma $NT_{50}$ values were of 297, 10,433 and 3,138, respectively (FIG. 4B and FIG. 6). Finally, clones of antibodies with shared IGHV and IGLV genes were among the best neutralizers, e.g., antibody C002 composed of IGHV3-30/IGKV1-39 is shared by the 2 donors with the best plasma neutralizing activity (red pie slice in FIGS. 5B and 6). It was concluded that even individuals with modest plasma neutralizing activity harbor rare IgG memory B cells that produce potent SARS-CoV-2 neutralizing antibodies.

To determine whether human anti-SARS-CoV-2 monoclonal antibodies with neutralizing activity can bind to distinct domains on the RBD, we performed bilayer interferometry experiments in which a preformed antibody-RBD immune complex was exposed to a second monoclonal. The antibodies tested comprised 3 groups, all of which differ in their binding properties from CR3022, an antibody that neutralizes SARS-CoV and binds to, but does not neutralize SARS-CoV-2 (ter Meulen, J. et al. PLoS Med 3, e237(2006); Yuan, M. et al. Science 368, 630-633 (2020).). Representatives of each of the 3 groups include: C144 and C101 in Group 1; C121 and C009 in Group 2; C135 in Group 3. All of these antibodies can bind after CR3022. Groups 1 and 2 also bind after Group 3, and Groups 1 and 2 differ in that Group 1 can bind after Group 2 but not vice versa (FIGS. 6F-6N). It was concluded that similar to SARS-CoV, there are multiple distinct neutralizing epitopes on the RBD of SARS-CoV-2.

To further define the binding characteristics of Groups 1 and 2 antibodies, SARS-CoV-2 S-Fab complexes were imaged by negative stain electron microscopy (nsEM) using C002 (Group 1, an IGHV3-30/IGKV1-39 antibody, which is clonally expanded in 2 donors), C119 and C121 (both in Group 2) Fabs (FIGS. 6F-6R and FIG. 16). Consistent with the conformational flexibility of the RBD, 2D class averages showed heterogeneity in both occupancy and orientations of bound Fabs for both groups (FIGS. 4O-6Q). The low resolution of NS EM reconstructions precludes detailed binding interpretations, but the results are consistent with Fabs from both groups being able to recognize "up" and "down" states of the RBD, as previously described for some antibodies targeting this epitope (Walls, A. C. et al. Cell 176, 1026-1039 (2019); Pinto, D. et al. Nature, doi:10.1038/s41586-020-2349-y (2020).). The 3D reconstructions are also consistent with competition measurements indicating that Groups 1 and 2 antibodies bind a RBD epitope distinct from antibody CR3022 (FIGS. 6F-6N) and with a single-particle cryo-EM structure of a C105-S complex (https://www.biorxiv.org/content/10.1101/2020.05.28.121533v1.full.pdf). In addition, the structures suggest that the antibodies bind the RBD with different angles of approach, with Group 1 antibodies more similar to the approach angle of the SARS-CoV antibody S230 (Zhu, Z. et al. Proc Natl Acad Sci USA 104, 12123-12128 (2007).) (FIG. 6R).

Human monoclonal antibodies with neutralizing activity against pathogens ranging from viruses to parasites have been obtained from naturally infected individuals by single cell antibody cloning. Several have been shown to be effective in protection and therapy in model organisms and in early phase clinical studies, but only one antiviral monoclonal is currently in clinical use (Salazar, G., et al. NPJ Vaccines 2, 19 (2017).). Antibodies are relatively expensive and more difficult to produce than small molecule drugs. However, they differ from drugs in that they can engage the host immune system through their constant domains that bind to Fc gamma receptors on host immune cells (Bournazos, S. & Ravetch, J. V. Immunol Rev 275, 285-295 (2017).). These interactions can enhance immunity and help clear the pathogen or infected cells, but they can also lead to disease enhancement during Dengue (Feinberg, M. B. & Ahmed, R. Science 358, 865-866 (2017)) and possibly coronavirus infections (Iwasaki, A. & Yang, Y. Nat Rev Immunol, doi:10.1038/s41577-020-0321-6 (2020).). This problem has impeded Dengue vaccine development but would not interfere with the clinical use of potent neutralizing antibodies that can be modified to prevent Fc gamma receptor interactions and remain protective against viral pathogens (Van Rompay, K. K. A. et al. Proc Natl Acad Sci USA 117, 7981-7989 (2020).).

Antibodies are essential elements of most vaccines and will likely be a crucial component of an effective vaccine against SARS-CoV-2 (Plotkin, S. A. Clin Vaccine Immunol 17, 1055-1065 (2010); Yu, J. et al. Science, doi:10.1126/science.abc6284 (2020); Chandrashekar, A. et al. Science, doi:10.1126/science.abc4776 (2020).). Recurrent antibodies have been observed in other infectious diseases and vaccinal responses (Wang, Q. et al. Cell Host Microbe, doi:10.1016/j.chom.2020.05.010 (2020); Scheid, J. F. et al. Science 333, 1633-1637 (2011); Robbiani, D. F. et al. Cell 169, 597-609 e511(2017); Ehrhardt, S. A. et al. Nat Med 25, 1589-1600 (2019); Pappas, L. et al. Nature 516, 418-422 (2014).). The observation that plasma neutralizing activity is low in most convalescent individuals, but that recurrent anti-SARS-CoV-2 RBD antibodies with potent neutralizing activity can be found in individuals with unexceptional plasma neutralizing activity suggests that humans are intrinsically capable of generating anti-RBD antibodies that potently neutralize SARS-CoV-2. Thus, vaccines that selectively and efficiently induce antibodies targeting the SARS-CoV-2 RBD may be especially effective.

Example 3

This example describes the materials, methods, and instrumentation used in EXAMPLE 4.

Human subjects. Samples of peripheral blood were obtained upon written consent from community participants under protocols approved by the Institutional Review Board of the Rockefeller University (DRO-1006). Details on the demographics of the cohort are provided in (Robbiani et al., 2020).

Cell lines. HEK293T cells for pseudovirus production and HEK293TACE2 cells for pseudovirus neutralization experiments were cultured at 37° C. and 5% CO2 in Dulbecco's modified Eagle's medium (DMEM, Gibco) supplemented with 10% heat-inactivated fetal bovine serum (FBS, Sigma-Aldrich) and 5 µg/ml Gentamicin (Sigma-Aldrich). The medium for the 293TAce2 cells additionally contained 5 µg/ml Blasticidin (Gibco). For constitutive expression of ACE2 in 293T cells, a Cdna encoding ACE2, carrying two inactivating mutations in the catalytic site (H374N & H378N), was inserted into CSIB 3' to the SFFV promoter (Kane et al., 2016). 293TACE2 cells were generated by transduction with CSIB based virus followed by selection with 5 µg/ml Blasticidin (Gibco). Expi293F cells (Gibco) for protein expression were maintained at 37° C. and 8% CO2 in Expi293 Expression medium (Gibco), transfected using Expi293 Expression System Kit (Gibco) and maintained under shaking at 130 rpm. The gender of the HEK293T, HEK293TACE2 and Expi293F cell lines is female. Cell lines were not specifically authenticated.

Bacteria. E. coli DH5α (Zymo Research) for propagation of expression plasmids were cultured at 37° C. in LB broth (Sigma-Aldrich) with shaking at 250 rpm.

Viruses. To generate pseudotyped viral stocks, HEK293T cells were transfected with pNL4-3ΔEnv-nanoluc and pSARS-CoV2-Strunc (Robbiani et al., 2020) using polyethyleneimine, leading to production of HIV-1-based virions carrying the SARS-CoV-2 S protein at the surface. Eight hours after transfection, cells were washed twice with PBS and fresh media was added. Supernatants containing virions were harvested 48 hours post transfection, filtered and stored at −80° C. Infectivity of virions was determined by titration on 293TACE2 cells.

Collection of human samples. Convalescent and healthy donor plasma samples were collected and processed as described (Robbiani et al., 2020). The convalescent plasma samples used for nsEMPEM were from residents in the State of New York: COV21 (a 54-year-old male Hispanic, collection 27 days after symptom onset), COV57 (a 66-year-old male Caucasian, collection 21 days after symptom onset), and COV107 (a 53-year-old female Caucasian, collection 29 days after symptom onset). An analysis of SARS-CoV-2 genomes in the GISAID database with sample collection dates in March 2020 (contemporaneous with the infections of individuals COV21, COV57, and COV107) was performed to identify any viral spike mutations likely to have been present. For SARS-CoV-2 genomes of New York State residents from March 2020, 468 of 475 contained the D614G mutation. Thus, based on state-level mutant frequencies, these individuals were likely to have been infected with D614G-containing viruses. All other spike mutations in these genomes had a frequency below 2%. All participants provided written informed consent before sample collection at the Rockefeller University Hospital and the study was conducted in accordance with Good Clinical Practice. Anticoagulated plasma was heat-inactivated (56° C. for 1 hour) prior to shipment to Caltech and stored at 4° C. thereafter (Robbiani et al., 2020).

Phylogenetic trees. Sequence alignments of S proteins and RBD/S1$^B$ domains were made with Clustal Omega (Sievers et al., 2011). Phylogenetic trees were calculated from these amino acid alignments using PhyML 3.0 (Guindon et al., 2010) and visualized with PRESTO (http://www.atgc-montpellier.fr/presto).

Cloning and expression of recombinant CoV proteins. Codon-optimized nucleotide sequences encoding the SARS-CoV-2 S ectodomain (residues 161206 of an early SARS-CoV-2 sequence isolate; GenBank MN985325.1, which has an Asp at position 614, so does not include the D614G mutation described as possibly more transmissible in (Korber et al., 2020)), SARS-CoV S (residues 12-1193; GenBank AAP13441.1), MERS-CoV S (residues 19-1294; GenBank JX869059.2), HCoV-OC43 (residues 15-1263; GenBank AAT84362.1), HCoV-NL63 (residues 16-1291; GenBank AAS58177.1), and HCoV-229E (residues 17-1113; GenBank AAK32191.1) were synthesized and subcloned into the mammalian expression pTwist-CMV BetaGlobin vector by Twist Bioscience Technologies. The S proteins were modified as previously described (Li et al., 2019; Tortorici et al., 2019; Walls et al., 2020). Briefly, the S ectodomain constructs included an N-terminal mu-phosphatase signal peptide, 2P stabilizing mutations (Pallesen et al., 2017) and a C-terminal extension (GSG-RENLYFQG (SEQ ID NO: 3240) (TEV protease site), GGGSG-YIPEAPRDGQAYVRKDGEWVLLSTFL (SEQ ID NO: 3238) (foldon trimerization motif), G-HHHHHHHH (SEQ ID NO: 3239) (octa-histidine tag), and GLNDIFEAQKIEWHE (SEQ ID NO: 3234) (AviTag)). For SARS-CoV-2, MERS-CoV, HCoV-NL63 and HCoV-OC43 mutations to remove the S1/S2 furin cleavage site were introduced.

Codon-optimized nucleotide sequences encoding the receptor binding domain (RBD) for SARS-CoV-2 (residues 331-524) SARS-CoV S (residues 318-510), MERS-CoV S (residues 367-588), HCoV-NL63 (residues 481-614), and corresponding $S1^B$ domains for HCoV-OC43 (residues 324-632), and HCoV-229E (residues 286-434) were synthesized and subcloned into the mammalian expression pTwist-CMV BetaGlobin vector by Twist Bioscience Technologies. The $RBD/S1^B$ constructs included an N-terminal human IL-2 signal peptide and dual C-terminal tags (G-HHHHHHH (SEQ ID NO: 3239) (octa-histidine), and GLNDIFEAQK-IEWHE (SEQ ID NO: 3234) (AviTag)).

The S protein and $RBD/S1^B$ constructs were expressed by transient transfection of Expi293F cells (Gibco) and purified from clarified transfected cell supernatants four days post-transfection using HisTrap FF and HisTrap HP columns (GE Healthcare Life Sciences). After concentration, affinity-purified proteins were further purified by size-exclusion chromatography (SEC) using a HiLoad 16/600 Superdex 200 pg column (GE Healthcare Life Sciences) in 1×TBS (20 mM Tris-HCl pH 8.0, 150 mM NaCl, 0.02% NaN3). Peak fractions were analyzed by SDS-PAGE, and fractions corresponding to S trimers or monomeric $RBD/S1^B$ proteins were pooled and stored at 4° C.

SEC-MALS. Purified CoV-S trimers were concentrated to 1 mg/mL and loaded onto a Superose 6 Increase 10/300 GL column (GE Healthcare Life Sciences) and passed through a Wyatt DAWN coupled to a Wyatt UT-rEX differential refractive index detector (Wyatt Technology). Data were analyzed using Astra 6 software (Wyatt Technology) to determine glycoprotein molecular weights.

Purification of plasma IgGs and Fabs. IgGs were purified from plasma samples using 5-mL HiTrap MabSelect SuRe columns (GE Healthcare Life Sciences). Heat-inactivated plasma was diluted 10-fold with cold PBS, and samples were applied to prepacked columns at 1 mL/min. Bound IgGs were washed with 10 column volumes (CV) PBS and eluted with 5 CV 0.1M glycine, 100 mM NaCl, pH 3.0 directly into 10% v/v 1M Tris-HCl, pH 8. To produce polyclonal Fab fragments, IgGs were buffer exchanged into PBS by centrifugation with 30 kDa MWCO membrane centrifugal filter units (Millipore). Fabs were generated by papain digestion using crystallized papain (Sigma-Aldrich) in 50 mM sodium phosphate, 2 mM EDTA, 10 mM L-cysteine, pH 7.4 for 30-60 min at 37° C. at a 1:100 enzyme:IgG ratio. To remove undigested IgGs and Fc fragments, digested products were applied to a 1-mL HiTrap MabSelect SuRe column (GE Healthcare Life Sciences) and the flow-through containing cleaved Fabs was collected. Fabs were further purified by SEC using a Superdex 200 Increase 10/300 column (GE Healthcare Life Sciences) in TBS, before concentrating and storage at 4° C.

To evaluate binding of purified polyclonal IgGs or Fabs to CoV proteins, purified $S1^B$/RBD or S proteins were biotinylated using the Biotin-Protein Ligase-BIRA kit according to manufacturer's instructions (Avidity). Biotinylated-CoV proteins were captured on streptavidin coated 96-well plates (Thermo Scientific) by incubating with 100 pL of 2 pg/mL protein solution in TBS overnight at 4° C. Plates were washed 3× in washing buffer (1×TBST: 20 mM Tris, 150 mM NaCl, 0.05% Tween20, pH 8.0) and blocked with 200 pL blocking buffer (TBST-MS: 1×TBST+1% w/v milk, 1% v/v goat serum (Gibco) for 1 h at RT. Immediately after blocking, polyclonal IgGs or Fabs were assayed for binding at a 50 pg/mL starting concentration and seven 4-fold serial dilutions in blocking buffer. After 2 h incubation at RT, plates were washed 5 times with washing buffer and incubated with goat-anti-human IgG or goat-anti-human IgG(H+L) secondary antibody conjugated to horseradish peroxidase (HRP) (SouthernBiotech) in blocking buffer at a 1:4000 or 1:2000 dilution, respectively. Plates were washed 5 times with washing buffer and developed by addition of 100 pL 1-Step™ Ultra TMB-ELISA Substrate Solution (Thermo Scientific) for 3 min. The developing reaction was quenched by addition of 100 pl 1N HCl and absorbance was measured at 450 nm using Gen5 software on a Synergy Neo2 Reader (BioTek).

RBD Adsorption ELISAs. Plasmids for SARS-CoV-2 RBD 6×HisTag constructs (residues 319-541, GenBank: MN908947.3) were a gift from the lab of Florian Krammer (Mount Sinai) ("6×HisTag" disclosed as SEQ ID NO: 3241). SARS-CoV-2 RBD 6×HisTag constructs ("6×HisTag" disclosed as SEQ ID NO: 3241) were expressed by transient transfection of Expi293F cells (Gibco) and purified using HisTrap FF and HisTrap HP columns (GE Healthcare Life Sciences), followed by SEC using a HiLoad 16/600 Superdex 200 pg column (GE Healthcare Life Sciences) against 1×TBS (20 mM Tris-HCl pH 8.0, 150 mM NaCl, 0.02% NaN3). Purified protein was concentrated and buffer exchanged into 100 mM Sodium Bicarbonate pH 8.3, 500 mM NaCl using a gravity-flow chromatography with a PD-10 desalting column (GE Healthcare Life Sciences). Buffer-exchanged RBD was concentrated to 5 mL and covalently coupled to a 5 mL HiTrap NETS-activated Sepharose column (GE Healthcare Life Sciences) according to the manufacturer's protocol. Control resin was made using the same procedure to covalently couple 2G12, an HIV-1 mAb, as described (Scharf et al., 2015).

For RBD-absorption ELISA experiments to evaluate binding of purified polyclonal IgGs to CoV $S1^B$/RBD proteins after absorption of SARS-CoV-2 RBD-specific antibodies, biotinylated-$S1^B$/RBD proteins were captured on high-capacity streptavidin coated 96-well plates (Thermo Scientific) by incubating with 100 μL of 2 μg/mL protein solution in TBS overnight at 4° C. Plates were washed 3× in washing buffer and blocked as described above. For absorption of RBD-specific antibodies, 100 μL of SARS-CoV-2 RBD-coupled resin or 2G12 control resin was incubated with 100 μL of purified IgGs diluted to ~1 mg/mL for 1 h at RT with agitation. After incubation, SARS-CoV-2 RBD-coupled resin was gently centrifuged at 250×g for 2 min, and non-absorbed IgGs were removed by careful pipetting of the aqueous layer above the pelleted RBD-coupled resin. Unadsorbed and absorbed IgG samples were assayed at a 50 μg/mL starting concentration and seven 4-fold serial dilutions as described above.

Pseudotyped virus neutralization assays. Pseudoviruses based on HIV lentiviral particles were prepared as described (Robbiani et al., 2020). Four-fold serially diluted purified polyclonal IgGs and Fabs from COVID-19 plasmas were incubated with SARS-CoV-2 pseudotyped virus for 1 hour at 37° C. After incubation with 293TACE2 cells for 48 hours at 37° C., cells were washed twice with PBS, lysed with Luciferase Cell Culture Lysis 5× reagent (Promega), and NanoLuc Luciferase activity in lysates was measured using the Nano-Glo Luciferase Assay System (Promega). Relative luminescence units (RLUs) were normalized to values derived from cells infected with pseudotyped virus in the absence of purified plasma IgGs or Fabs. Half-maximal inhibitory concentrations ($IC_{50}$ values) for purified plasma IgGs and Fabs were determined as molar concentrations (to account for the IgG versus Fab difference in molecular weight) using 4-parameter nonlinear regression (Prism, GraphPad).

Negative-stain electron microscopy (nsEM). Purified CoV-S trimers were adsorbed to freshly-glow discharged PureC 300 mesh carbon-coated copper grids (EMD Sciences) for 1 min followed by 2% uranyl formate staining. Micrographs were recorded using Digital Micrograph software on a 120 kV FEI Tecnai T12 equipped with a Gatan Ultrascan 2 k×2 k CCD at a 52,000× nominal magnification.

nsEMPEM. Methods were adapted from (Bianchi et al., 2018). To form polyclonal Fab-S complexes, 30 µg of SARS-CoV-2 S trimers were incubated overnight at RT with 30-50 mg/mL Fabs in 100 µL total volume (corresponding to ~1000× the $EC_{50}$ values for ELISAs using purified polyclonal Fabs), and the complexes were purified by SEC on a Superose 6 increase 10/300 GL column (GE Healthcare Life Sciences). Fractions containing complexes were pooled and concentrated to 50 µg/mL and passed through a 0.1 µm filter before deposition on 300 mesh carbon-coated copper grids (source?) and stained with 1% (w/v) uranyl formate (source?). Grids were imaged at 300 keV using a Titan Krios transmission electron microscope (Thermo Fisher) operating at RT, equipped with a K3 direct electron detector (Gatan) using SerialEM 3.7? (Mastronarde, 2005). Images were processed in cryoSPARC v 2.14, and a reference-free particle stack was generated using a Gaussian blob picker (Punjani et al., 2017). Particles corresponding to S-Fab complexes were identified by extensive 2D classification to identify class averages that displayed structural elements interpreted as Fab density and also represented different views. Extracted particles were used to generate ab initio models in cryoSPARC that were further processed by 3D classification to separate out complexes and S trimer structures alone. Figures were prepared using UCSF Chimera (Goddard et al., 2007; Pettersen et al., 2004).

X-ray crystallography. The Fab from the C105 monoclonal IgG was expressed, purified, and stored as described (Scharf et al., 2015; Schoofs et al., 2019). Crystallization trials were performed at room temperature using the sitting drop vapor diffusion method by mixing equal volumes of C105 Fab and reservoir using a TTP LabTech Mosquito robot and commercially-available screens (Hampton Research). After optimization of initial hits, crystals were obtained in 0.15 M lithium sulfate, 0.1 M citric acid pH 3.5, 18% v/v PEG 6000 at 20° C. Crystals were transferred stepwise to 20% glycerol cryoprotectant before being cryopreserved in liquid nitrogen.

X-ray diffraction data were collected for C105 Fab at the Stanford Synchroton Radiation Lightsource (SSRL) beamline 12-1 on a Pilatus 6M pixel detector (Dectris). Data from a single crystal were indexed and integrated in XDS (Kabsch, 2010) and merged using AIMLESS in CCP4 (Winn et al., 2011) (Table 16). The structure of C105 Fab was determined by molecular replacement in PHASER (McCoy et al., 2007) using the B38 Fab coordinates from PDB code 7BZ5 after removal of CDR loops as a search model. The C105 Fab coordinates were refined using Phenix (Adams et al., 2010) and cycles of manual building in Coot (Emsley et al., 2010) (Table 16).

Cryo-EM Sample Preparation. Purified C105 Fab was incubated with SARS-CoV-2 S trimer at a 2:1 molar ratio per protomer on ice for 30 minutes prior to purification by SEC on a Superose 6 Increase 10/300 GL column (GE Healthcare Life Sciences). Fab-S complexes were concentrated to 1.6 mg/ml in Tris-buffered saline (TB S). Immediately before deposition onto a 300 mesh, 1.2/1.3 AuUltraFoil grid (Electron Microscopy Sciences) that had been freshly glow-discharged for 1 min at 20 mA using a PELCO easiGLOW (Ted Pella), 3 µL of complex was mixed with 0.5 µL of a 0.5% w/v octyl-maltoside solution (Anatrace). Samples were vitrified in 100% liquid ethane using a Mark IV Vitrobot (Thermo Fisher) after blotting for 3 s with Whatman No. 1 filter paper at 22° C. and 100% humidity.

Cryo-EM Data Collection and Processing. For the C105-S trimer complex, micrographs were collected on a Titan Krios transmission electron microscope (Thermo Fisher) operating at 300 kV using SerialEM automated data collection software (Mastronarde, 2005). Movies were obtained on a Gatan K3 Summit direct electron detector operating in counting mode at a nominal magnification of 105,000× (super-resolution 0.418 Å/pixel) using a defocus range of −1 to −2.5 µm. Movies were collected with an 1.9 s exposure time with a rate of 22 eipix/s, which resulted in a total dose of ~60 e−/Å$^2$ over 40 frames. The 5,940 cryo-EM movies were patch motion corrected for beam-induced motion including dose-weighting within cryoSPARC v2.15 (Punjani et al., 2017) after binning super resolution movies by 2 (0.836 Å/pixel). The non-dose-weighted images were used to estimate CTF parameters using CTFFIND4 (Rohou and Grigorieff, 2015), and micrographs with power spectra that showed poor CTF fits or signs of crystalline ice were discarded, leaving 5,316 micrographs. Particles were picked in a reference-free manner using Gaussian blob picker in cryoSPARC (Punjani et al., 2017). An initial 565,939 particle stack was extracted, binned ×2 (1.68 Å/pixel), and subjected to iterative rounds of reference-free 2D classification to identify class averages corresponding to intact S-trimer complexes with well-defined structural features. This routine resulted in a new particle stack of 71,289 particles, which were unbinned (0.836 Å/pixel) and re-extracted using a 352 box size. Two ab initio volumes were generated, with one class of 61,737 particles revealing an S-trimer complexed with two C105 Fabs.

Particles were further 3D classified (k=3) and heterogeneously refined to reveal two distinct states of the C105-S trimer complex. State 1 (37,615 particles) displaying 2 "up" RBD conformations bound by 2 C105 Fabs, and state 2 (14,119 particles) that displayed 3 "up" RBD conformations bound by 3 C105 Fabs. Particles from states 1 and 2 were separately refined using non-uniform 3D refinement imposing either C1 or C3 symmetry, respectively, to final resolutions of 3.6 Å (state 1; 37,615 particles) and 3.7 Å (state 2; 14,119 particles) according to the gold-standard FSC (Bell et al., 2016). Given that the RBD "up" conformations with C105 Fabs bound were similar in both states 1 and 2, improvements to the resolution at the RBD-C105 Fab interface were achieved by combining the entire particle stack (~52 k particles) for a focused, non-uniform 3D refinement. A soft mask was generated from the state 1 volume (5-pixel extension, 10-pixel soft cosine edge) for the S1 subunits and C105 Fab variable domains. These efforts resulted in a modest improvement in the RBD-C105 Fab interface (FIG. 29D), and an overall resolution of 3.4 Å according to the gold-standard FSC.

Cryo-EM Structure Modeling and Refinement. Initial coordinates were generated by docking individual chains from reference structures into cryo-EM density using UCSF Chimera (Goddard et al., 2007). The following coordinates were used: SARS-CoV-2 S trimer: PDB code 6VYB, "up" RBD conformations: PDB code 7BZ5, C105 Fab: this study. These initial models were then refined into cryo-EM maps using one round of rigid body refinement followed by real space refinement. Sequence-updated models were built manually in Coot (Emsley et al., 2010) and then refined using iterative rounds of refinement in Coot and Phenix (Adams et al., 2010). Glycans were modeled at possible N-linked glycosylation sites (PNGSs) in Coot using 'blurred' maps processed with a variety of B-factors (Terwilliger et al., 2018). Validation of model coordinates was performed using MolProbity (Chen et al., 2010) and is reported in Table 17.

Structural Analyses. Structural figures were made using PyMOL (Version 1.8.2.1 Schrodinger, LLC) or UCSF Chimera (Goddard et al., 2007). Local resolution maps were calculated using cryoSPARC v 2.15 (Punjani et al., 2017).

Example 4

A newly-emergent betacoronavirus, SARS-CoV-2, resulted in a pandemic in 2020, causing the respiratory disease COVID-19 (Wu et al., 2020b; Zhou et al., 2020). SARS-CoV-2 is the third zoonotic betacoronavirus to infect humans this century, following SARS-CoV and MERS-CoV (Middle East Respiratory Syndrome) infections in 2003 and 2012, respectively (de Wit et al., 2016). In addition, four globally-distributed human coronaviruses, HCoV-OC43, HCoV-HKU1 (beta coronaviruses), and HCoV-NL63, HCoV-229E (alpha coronaviruses), contribute to 15-30% of common colds (Fung and Liu, 2019). The neutralizing antibody response to coronaviruses is primarily directed against the trimeric spike glycoprotein (S) on the viral membrane envelope, which serves as the machinery to fuse the viral and host cell membranes (Fung and Liu, 2019). Coronavirus S proteins contain three copies of an S1 subunit comprising the $S1^A$ through $S1^D$ domains, which mediates attachment to target cells, and three copies of an S2 subunit, which contains the fusion peptide and functions in membrane fusion (FIG. 17A). Neutralizing antibody responses against SARS-CoV-2, SARS-CoV, and MERS-CoV S proteins often target the receptor-binding domain (RBD; also called the $S1^B$ domain) (Hwang et al., 2006; Pinto et al., 2020; Prabakaran et al., 2006; Reguera et al., 2012; Rockx et al., 2008; Walls et al., 2020; Walls et al., 2019; Widjaja et al., 2019; Wrapp and McLellan, 2019; Wrapp et al., 2020).

Figure 1B:
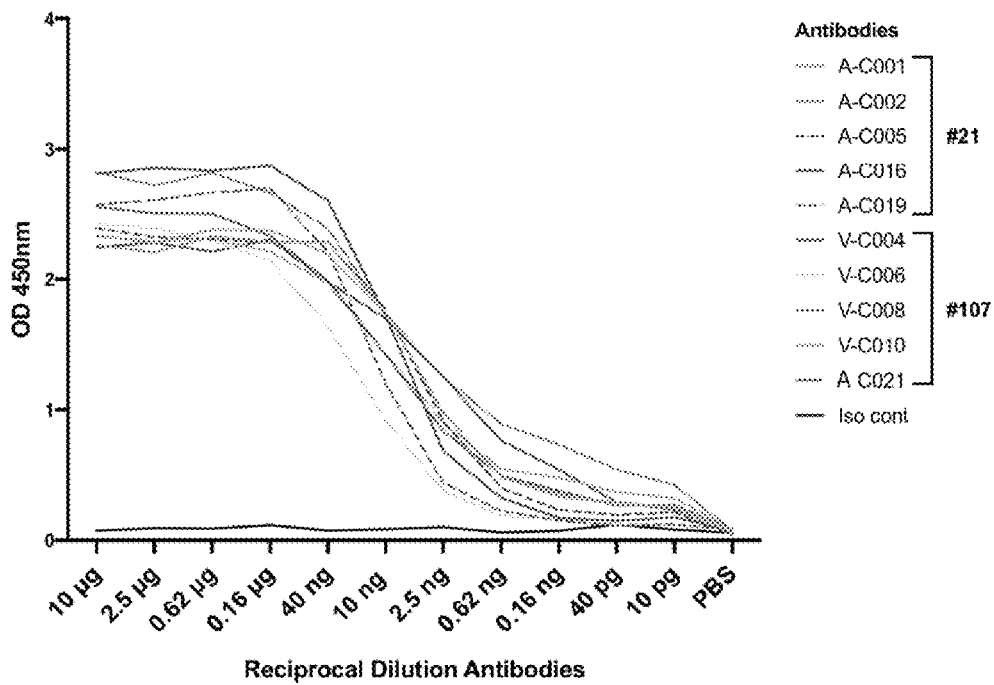
Figures 2A, 2B:
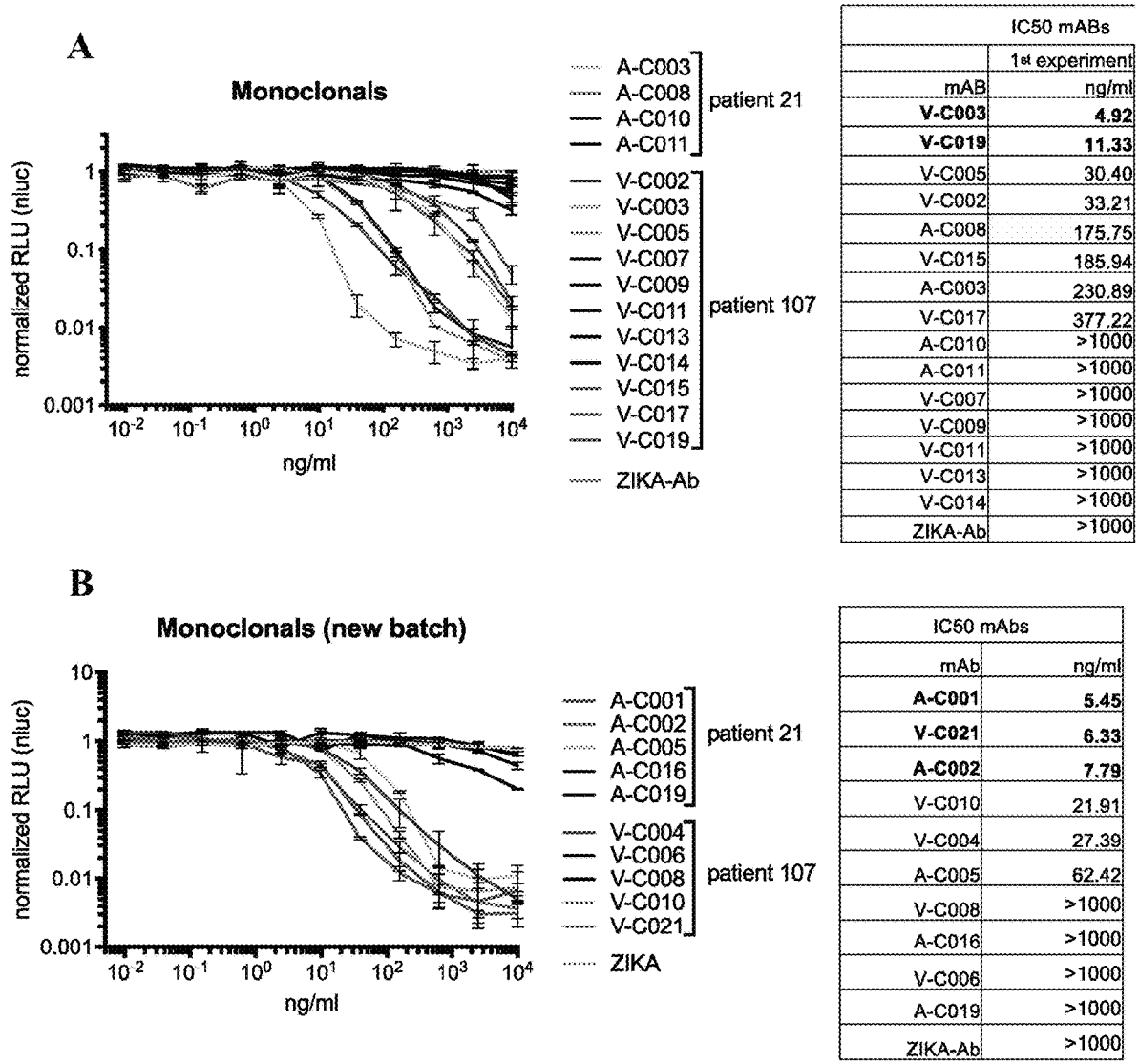
FIGS. 2A and 2B (collectively "FIG. 2") are a set of graphs showing the results of monoclonal antibodies in ELISA for binding to the Receptor Binding Domain (RBD) of the virus Spike protein.

The S proteins of SARS-CoV-2 (1273 residues, strain Wuhan-Hu-1) and SARS-CoV (1255 residues, strain Urbani) share 77.5% amino acid sequence identity, while the S proteins of SARS-CoV-2 and MERS-CoV (1353 residues, strain EMC2012) are more distantly related, sharing only 31% identity (FIGS. 17B and 17C). Sequence identities between SARS-CoV-2 and common cold coronavirus S proteins are even lower, varying between 25% and 30%. Phylogenetic analyses confirm that SARS-CoV-2 and SARS-CoV are more closely related to each other than to other human coronaviruses (FIG. 1B). The RBD/$S1^B$ domains show varying degrees of sequence identity, ranging from 13% (SARS-CoV-2 and HCoV-NL63) to 74% (SARS-CoV-2 and SARS-CoV). Nevertheless, the 3D structures of S protein trimer ectodomains are similar to each other and to other coronavirus S structures, including the finding of flexible RBDs ($S1^B$ domains) that can be in various "up" conformations or in the "down" conformation of the closed pre-fusion trimer (Kirchdoerfer et al., 2016; Li et al., 2019; Walls et al., 2020; Walls et al., 2016; Wrapp et al., 2020; Yuan et al., 2017). Primary amino acid sequence differences in the RBDs of SARS-CoV-2 and SARS-CoV compared with MERS-CoV (FIG. 1B,C) result in binding to different host receptors: angiotensin-converting enzyme 2 (ACE2) for SARS-CoV-2 and SARS-CoV (Hoffmann et al., 2020; Li et al., 2003; Zhou et al., 2020) and dipeptidyl peptidase 4 for MERS-CoV (Raj et al., 2013). One of the common cold coronaviruses, HCoV-NL63, also uses its RBD ($S1^B$) to bind ACE2, although its interactions differ structurally from RBD-ACE2 interactions of SARS-CoV-2 and SARS-CoV (Tortorici and Veesler, 2019), whereas HCoV-OC43 and HCoV-HKU1 uses their $S1^A$ domains to bind host receptors including 9-O-acetylated sialic acids (Tortorici et al., 2019).

Understanding the antibody response to SARS-CoV-2 S protein is of critical importance because correlates of protection for vaccines usually involve antibodies (Plotkin, 2001, 2008, 2010). Moreover, antibodies are being considered as therapeutics for COVID-19 patients (Zhou and Zhao, 2020). Relatively little is known about antibody recognition of SARS-CoV-2 S compared with other coronavirus S proteins (Graham et al., 2013; Gralinski and Baric, 2015; Wan et al., 2020). However, structures of S trimer, RBD-Fab, RBD-ACE2, and S trimer-Fab complexes for SARS-CoV-2 and other coronaviruses are informative for interpreting and understanding the antibody response to SARS-CoV-2 (Gui et al., 2017; Kirchdoerfer et al., 2020; Kirchdoerfer et al., 2016; Kirchdoerfer et al., 2018; Pallesen et al., 2017; Pinto et al., 2020; Shang et al., 2020; Shang et al., 2018; Walls et al., 2016; Walls et al., 2017; Walls et al., 2019; Wang et al., 2020; Xiong et al., 2018; Yuan et al., 2020).

Here, we analyzed purified IgG and Fabs from the plasmas of 10 COVID-19 convalescent individuals (Robbiani et al., 2020) for binding to trimeric S and monomeric RBD/$S1^B$ domains of six human coronaviruses and for neutralization of SARS-CoV-2 pseudoviruses. To better understand the binding mechanism of polyclonal antibodies, we further characterized plasma Fabs from two individuals using negative-stain electron microscopy polyclonal epitope mapping (nsEMPEM), showing that the polyclonal landscape includes antibodies that target epitopes in both SARS-CoV-2 $S1^A$ and RBD domains. In addition, we solved a 3.4 Å single-particle cryo-EM structure of an S trimer bound to a neutralizing monoclonal antibody (mAb), which targeted an epitope on an "up" RBD that overlapped with the RBD epitope identified by nsEMPEM and would sterically block ACE2 receptor binding. The epitopes we found represent binding classes defined by distinct VH gene segments, suggesting that these recurring classes are commonly represented in neutralizing antibodies against SARS-CoV-2 and provide criteria for evaluating neutralizing antibodies raised by infection or vaccination. Finally, we used modeling to suggest that distinct binding orientations allow for differential avidity effects, demonstrating the potential for inter-spike crosslinking that would increase effective affinities for some anti-S IgGs on SARS-CoV-2 virions.

Convalescent plasma IgG and Fab binding properties demonstrate recognition of diverse coronaviruses and effects of avidity. Convalescent plasma samples were collected from individuals who had recovered from COVID-19 at Rockefeller University Hospital (Robbiani et al., 2020). We isolated polyclonal IgGs from 10 convalescent plasmas (FIG. 18), most of which had high neutralizing titers (Robbiani et al., 2020), and compared binding of their IgGs to purified S proteins from SARS-CoV-2, SARS-CoV, MERS-CoV, HCoV-OC43, HCoV-NL63, and HCoV-229E (FIG. 24) by ELISA (FIGS. 18 and 26). Purified plasma IgGs recognized S proteins from all coronaviruses evaluated, with weaker binding observed for most samples to MERS-CoV (FIG. 19C) and common cold coronavirus S proteins (FIGS. 19D-F).

Amongst the plasmas (COV21, COV57, and COV107) chosen for further analysis based on ELISA EC50 values and strong neutralization potencies (Robbiani et al., 2020), IgGs from COV21 and COV57 showed the strongest binding to the S proteins from SARS-CoV-2 and SARS-CoV, with only the COV57 IgGs showing measurable binding to MERS-CoV S protein. The COV107 IgGs showed intermediate binding to SARS-CoV-2 and SARS-CoV and no binding to MERS-CoV S proteins (FIGS. 19A-C).

ELISAs against RBD (or $S1^B$ domain for two of the common cold coronavirus S proteins) showed the strongest binding to SARS-CoV-2 RBD for COV21, followed by COV57 and then COV107 IgGs, with the proportion of RBD versus S binding from COV21, COV72, and COV47 suggesting that the majority of the IgG responses from these plasmas were focused on the RBD, often a target of neutralizing antibodies in coronavirus infections (Hwang et al., 2006; Pinto et al., 2020; Prabakaran et al., 2006; Reguera et al., 2012; Rockx et al., 2008; Walls et al., 2020; Walls et al., 2019; Widjaja et al., 2019; Wrapp et al., 2020). The only appreciable reactivity with SARS-CoV and MERS-CoV RBDs was exhibited by COV21 IgG, which bound to SARS-CoV RBD (FIG. 19B). Although we cannot determine whether the same IgGs are binding all three S proteins, the potential for cross-reactive binding of SARS-CoV antibodies was demonstrated for a mAb that was isolated from a SARS-infected individual, which was shown to recognize SARS-CoV and SARS-CoV-2 RBDs (Pinto et al., 2020). No reactivity with MERS-CoV RBD was observed for any of the polyclonal IgGs (FIG. 19C). For most of the plasma IgGs, binding to the RBD was substantially weaker than binding to the counterpart S protein, with the exception of the strong COV21 and COV72 responses to the SARS-CoV-2 RBD. Most of the plasma IgGs exhibited stronger binding to the common cold $S1^B$/RBDs than to the counterpart S protein trimers (FIGS. 19D-F).

To assess the degree to which cross-reactive recognition contributed to binding of plasma IgGs to RBD/$S1^B$ domains, we repeated the ELISAs before and after adsorption with SARS-CoV-2 RBD-coupled resin or a control resin for five plasma IgG samples (FIG. 26). As a positive control, purified IgGs incubated with the RBD resin showed little or no SARS-CoV-2 RBD binding (FIG. 26A). Binding to SARS-CoV RBD was also reduced for the IgGs remaining after SARS-CoV-2 RBD adsorption (FIG. 26B), suggesting cross-reactive recognition consistent with the 78% sequence conservation and structural homology of SARS-CoV-2 RBD and SARS-CoV RBD (Walls et al., 2020). By contrast, adsorption of plasma IgGs with SARS-CoV-2 RBD resins had only a modest effect on binding to common cold coronavirus RBDs (FIGS. 26D-F), consistent with little to no cross-reactive antibody recognition, likely due to the low conservation between the SARS-CoV-2 RBD and mild coronavirus RBDs (Premkumar et al., 2020). We also note that IgGs from control plasmas collected from individuals not exposed to SARS-CoV-2 exhibited binding to common cold coronavirus RBDs that was not affected by SARS-CoV-2 RBD adsorption (FIG. 26), again consistent with pre-exposure to mild coronaviruses rather than cross-reactivity with SARS-CoV-2 RBD.

Taken together, these results indicate: (i) The binding strengths and patterns of different coronavirus S protein recognition were diverse across COVID-19 individual plasma samples, (ii) Convalescent COVID-19 individuals harbor antibodies to the SARS-CoV-2 S protein, and to a lesser extent, the RBD/S1B, as well as reactivity to other coronaviruses, which likely represents previous exposure to common cold viruses, (iii) Polyclonal IgGs from individual plasma samples that bind to S proteins from MERS-CoV and/or SARS-CoV may display cross-reactive recognition, since the plasma donors were unlikely to have been infected with either of these coronaviruses, and (iv) Compared to the COV57 and COV107 plasmas, the COV21 IgG response had a higher proportion of IgGs that recognized the SARS-CoV-2 RBD.

We also evaluated the degree to which avidity effects contributed to the strength of binding of plasma IgGs to S proteins and RBDs by comparing the binding of bivalent polyclonal IgGs to monovalent Fabs, prepared by proteolytic cleavage of purified polyclonal IgGs (FIGS. 18B and 18C). Differential effects were evident in IgG to Fab comparisons: most of the SARS-CoV-2 anti-S response was reduced by at least 50% in the case of monovalent Fabs for all plasmas except for COV57 (FIG. 19A). Recognition of the other coronavirus S proteins was also diminished for Fabs compared to intact IgGs (FIGS. 19B-F). For the three plasma IgGs that were further evaluated, the largest relative differences in IgG versus Fab binding to SARS-CoV-2 S protein was observed for COV21 and COV107; the IgG versus Fab binding difference for COV57 was less pronounced (FIG. 19A). Notably, the SARS-CoV-2 S protein and RBD ELISAs showed that a higher fraction of the COV21 plasma IgGs were RBD-specific compared with the COV57 IgGs (FIGS. 19A and 19B) (Robbiani et al., 2020).

In summary, the ELISA data indicate that IgGs in plasma samples differ in their degree of focus upon epitopes within the S protein RBD/$S1^B$ domain, their relative amounts of reactivity with SARS-CoV, MERS-CoV, and common cold coronaviruses, and the extent to which avidity effects contribute to the tighter binding of polyclonal bivalent IgGs as compared with monovalent Fab s.

Plasma IgGs are more potent neutralizers than plasma Fabs. To investigate whether the bivalent architecture or larger size of IgGs compared with Fabs resulted in increased neutralization potencies, we measured the potencies of purified plasma IgGs and Fabs using in vitro neutralization assays (FIG. 19G). SARS-CoV-2 pseudoviruses were constructed as described (Robbiani et al., 2020), and the concentrations of IgGs and Fabs at which 50% neutralization was achieved ($_{IC50}$ values) were calculated. All tested plasma IgGs neutralized pseudoviruses at lower molar concentrations than their Fab counterparts, with increased potencies ranging from 6- to 100-fold (FIG. 19H). The increased potency of the IgGs compared to Fabs was statistically significant (p=0.0003), even when accounting for two Fabs per IgG. We conclude that bivalent IgGs more effectively neutralize SARS-CoV-2 pseudoviruses than monovalent Fabs.

EM reveals distinct predominant epitopes targeted by convalescent plasma antibodies. We next used negative stain polyclonal electron microscopy (nsEMPEM) (Bianchi et al., 2018; Nogal et al., 2020) to map epitopes from Fabs isolated from convalescent COVID-19 plasma IgGs onto the SARS-CoV-2 S protein. In this method, Fabs that bind to an antigenic target are separated from non-binding Fabs in a polyclonal mixture by size-exclusion chromatography (SEC), Fab-antigen complexes are imaged by EM, and 2D/3D classification were used to identify predominant epitopes (Bianchi et al., 2018; Nogal et al., 2020) (FIGS. 18A-C). Typically, Fabs are incubated at 1000-2000× above EC50 values calculated from binding assays (Bianchi et al., 2018; Nogal et al., 2020). For most COVID-19 plasmas, Anti-S Fab EC50 values were estimated to be >50 µg/mL (FIG. 25). However, purified polyclonal Fabs from COV21 and COV57 plasmas, which had approximate EC50s ranging from 20-50 µg/mL, showed stable binding by SEC after incubation with SARS-CoV-2 S trimers (FIG. 18D), and 2D class averages showed evidence of bound Fabs (FIG. 28). By contrast, purified Fabs from COV107 ($_{EC50}$>50 µg/mL) showed no evidence of binding to S by SEC (data not shown) or in a 3D reconstruction (FIG. 20A).

In order to verify that extra densities in nsEMPEM 3D reconstructions corresponded to bound Fab(s), we first solved a 3D reconstruction of SARS-CoV-2 S alone, revealing the expected low-resolution structure of the closed, prefusion S trimer (FIG. 20A). A 3D reconstruction of COV21 Fabs complexed with S showed recognizable density for the S trimer with a single extending density at the apex of the trimer corresponding to a Fab or mixture of Fabs bound to a similar epitope (FIG. 20A). The density could be fit to an S trimer with a Fab bound to a single RBD in an "up" position using coordinates from SARS-CoV-2 S trimer structures (Walls et al., 2020; Wrapp et al., 2020), consistent with ELISA results mapping the COV21 response to the SARS-CoV-2 RBD (FIG. 19A). The complex structure and the position of the COV21 Fab(s) closely resembled a structure of SARS-CoV S bound to a Fab from the S230 mAb isolated from a SARS-CoV-infected individual, whose epitope overlaps with the binding site for the ACE2 receptor (Walls et al., 2019) (FIG. 20B). Interestingly, S230 binding was shown to functionally mimic ACE2 binding, allowing cleavage of the SARS-CoV S protein to promote fusogenic conformational rearrangements (Walls et al., 2019). While the COV21 Fab complex reconstruction showed occupancy for one S-protomer with an RBD in an "up" position (FIG. 20A), COV21 Fab(s) could also bind analogous to the S230 Fab-SARS-Cov S complex, where classes of S trimer structures were found with two "up"/one "down" and three "up" RBD conformations (Walls et al., 2019).

Moreover, antibody S230, whose binding orientation resembles the position observed in the COV21 Fab(s) reconstruction (FIG. 20B), appears to be a member of a class of recurrent anti-SARS mAbs. It belongs to a set of 10 non-clonally-related VH3-30-derived mAbs isolated from an individual infected with SARS-CoV, which represented 40% of the clones isolated from this individual (Pinto et al., 2020). Notably, these clones contained similar 9 amino acid CDRL3 sequences (consensus sequence MQGTHWPPT (SEQ ID NO: 3656)), suggesting that this group of mAbs has a common mode of binding, partially dependent on VH3-30-derived features. RBD residues 473 and 475 contacted by the antibody heavy chain in the S230 Fab-SARS-CoV structure (Walls et al., 2019) are conserved between SARS-CoV and SARS-CoV-2, and these residues are in the vicinity of antibody heavy chain residues N57 and K58. The only VH gene segments encoding the N57/K58 pair are VH3-30, VH3-30-3, and VH3-33 (Lefranc et al., 2015). When mAbs were isolated after single B cell sorting using SARS-CoV-2 RBD as a bait, COV21 antibodies included heavy chains derived from IGHV3-30, which were also found in sequenced antibodies from five other donor plasmas (Robbiani et al., 2020). The similarity in binding orientation of COV21 Fab(s) with S230 (FIG. 20B) suggests that COV21 Fab(s) may be members of the S230 recurrent class. Consistent with this hypothesis, 38 of 127 sequenced antibodies from the COV21 donor were derived from VH3-30 or from the closely-related VH3-30-3 or VH3-33 VH gene segments (Robbiani et al., 2020).

The COV57 Fab(s)-S structure also showed recognizable density for both the S trimer and a single bound Fab(s) (FIG. 20C). However, in this complex, the S trimer appeared closed with no RBDs in an "up" position, and the Fab density was not associated with an RBD, but rather with one of the S1$^A$ subunits. In the complex, the Fab(s) pointed downwards (i.e., towards the viral membrane) rather that upwards (away from the viral membrane), as seen for the COV21 Fab(s). The COV57 Fab(s) density was in the vicinity of loops on the S1$^A$ domain that were disordered in SARS-CoV-2 S trimer structures (Walls et al., 2020; Wrapp et al., 2020). Such flexibility could explain the diffuse nature of the COV57 Fab(s) density in this reconstruction. Interestingly, characterization of COV57 neutralization showed less correlation with RBD-specific antibodies relative to COV21 (Robbiani et al., 2020), consistent with the ELISAs (FIG. 19A) and nsEMPEM characterizations (FIG. 20C) reported here. This suggests that targeting S1 regions outside of the RBD may represent alternative modes for potent neutralization of SARS-CoV-2, as found for neutralizing antibodies isolated after vaccination against MERS-CoV in nonhuman primates (Wang et al., 2015).

A cryo-EM structure of a monoclonal Fab-S protein complex resembles the COV21 Fab(s)-S reconstruction. Although we could not resolve densities for bound Fabs in the COV107-S nsEMPEM reconstruction (FIG. 20A), RBD-binding mAbs isolated from the COV107 individual were potently neutralizing (Robbiani et al., 2020). We determined a 3.4 Å single-particle cryo-EM structure of the complex of one such antibody (C105; IC$_{50}$ for neutralization of SARS-CoV-2 pseudovirus=26.1 ng/mL) (Robbiani et al., 2020) bound to the SARS-CoV-2 S protein using a 1.8 Å crystal structure of the unbound C105 Fab for fitting to the cryo-EM density (FIGS. 21, 28, and 29; Tables 15 and 16).

We found two populations of C105 Fab-S complexes: an asymmetric S trimer with two "up" RBDs (state 1; 3.4 Å resolution), each of which was complexed with a Fab, and a symmetric trimer with three RBDs in the same "up" conformation (state 2; 3.7 Å resolution), again with each RBD complexed with a Fab (FIG. 21A). A subset of complexes in the cryo-EM structure of the S230 mAb bound to SARS-CoV S trimer were also found with three "up" RBDs bound to three Fabs (Walls et al., 2019), although in that structure, as in the C105-S structure, the majority of complexes had their RBDs in a two "up," one "down" configuration.

The C105-RBD interfaces were similar across the five examples in the state 1 and state 2 complex structures (FIG. 28), thus we describe the interface for one of the Fab-RBD complexes in the state 1 complex in which the resolution at the interface was improved by performing a focused refinement (Punjani et al., 2017) on the C105 Fab-RBD portion of the complex (FIG. 28). The C105 Fab uses its three heavy chain complementarity determining regions (CDRH1, CDRH2, and CDRH3) and two of its light chain CDRs (CDRL1 and CDRL3) to rest against the receptor-binding ridge of the RBD (FIGS. 21B and 21C). The majority of the antibody contacts are made by CDRH1, CDRH2, and CDRL1, with CDRH3 and CDRL3 playing minor roles. The C105 epitope overlaps with the COV21 epitope defined by nsEMPEM, which also rests against the receptor-binding ridge in the RBD, although the Fab(s) in the COV21 reconstruction are predicted to adopt a different angle of approach (FIG. 21D). Interestingly, the C105-RBD interaction closely resembles the RBD interaction of another COVID-19 donor-derived neutralizing mAb, B38 (FIG. 21E), as reported in a recent Fab-RBD crystal structure (Wu et al., 2020c). The heavy chains of both B38 and C105 are derived from the VH3-53 gene segment, whereas the light chain gene segments differ: KVJ-9 for B38 (Wu et al., 2020c) and LV2-8 for C105 (Robbiani et al., 2020). Accordingly, the CDRH1 and CDRH2 loops of both neutralizing antibodies share similar conformations and contribute more to the antibody-RBD interface than their CDRH3 loops (FIGS. 21B and 21E).

The common epitope of C105 and B38 overlaps with the binding site for ACE2 (FIG. 21F), rationalizing their potent neutralizing activities (Robbiani et al., 2020; Wu et al., 2020c). Given that COV21 was one of the more potent neutralizing plasmas of the 149 that were collected (Robbiani et al., 2020), the overlap in the C105/B38 neutralizing epitope with the nsEMPEM-defined predominant COV21 epitope suggests that recognition of the COV21 epitope by S230-like antibodies would also be neutralizing.

CDRH3 length is a characteristic of the recurring VH3-53/VH3-66 class of anti-SARS-CoV-2 RBD neutralizing antibodies. The shared binding mode of B38 and C105, both VH3-53-derived mAbs, defines a recurrent class of anti-SARS-CoV-2 mAbs. Among a large set (n=534) of cloned anti-SARS-CoV-2 mAbs against the RBD, those derived from VH3-53 and VH3-66 were over-represented (Robbiani et al., 2020). Other studies have also reported anti-SARS-CoV-2 mAbs derived from these genes (Brouwer et al., 2020; Cao et al., 2020; Chi et al., 2020; Ju et al., 2020; Rogers et al., 2020; Seydoux et al., 2020; Wu et al., 2020c; Zost et al., 2020). These VH gene segments encode V regions that differ in only one amino acid position, which is not in a CDR. Thus, in terms of V-gene-determined mAb classes, they are functionally equivalent. When grouping VH3-53 and VH3-66, over-representation of VH3-53/VH3-66-derived mAbs is significant (p=0.035). A notable characteristic of the VH3-53/VH3-66-derived subset (75 mAbs) within the 534 anti-RBD mAbs (Robbiani et al., 2020) was a bias towards shorter CDRH3s (as defined by IMGT) (Lefranc et al., 2015): 75% had lengths between 9 and 12 residues, which is significantly different from the human repertoire and from the entire set of 534 anti-SARS-CoV-2 RBD mAbs (two sample Kolmogorov-Smirnov test, p<0.001) (FIG. 30A).

Superposition of VH domains from unrelated antibodies with longer CDRH3s suggests that RBD residues 456-457 and/or 484-493 present a steric barrier limiting the CDRH3 loop lengths that are compatible with this binding orientation (FIG. 30B). A recent report identified a clonally-unrelated group of VH3-53/VH3-66 anti-SARS-CoV-2 mAbs based on CDRH3 sequence similarity to the anti-SARS-CoV mAb m396 (derived from VH1-69) (Cao et al., 2020). The structure of a SARS-CoV RDB complex with m396 (PDB code 2DD8) (Prabakaran et al., 2006) shows that mAb m396 does not share the B38/C105 binding mode. We suggest that the key feature of the VH3-53/VH3-66 mAbs identified based on CDRH3 sequence similarity to m396 (Cao et al., 2020) is their CDRH3 length (11 residues), and that these mAbs will share the B38/C105 binding mode, not the m396 binding mode.

Identified S mutations are unlikely to affect epitopes revealed by nsEMPEM and single-particle cryo-EM. A recent report suggested that a mutation in the S protein (D614G) increases transmissibility of SARS-CoV-2 (Korber et al., 2020), and it has been speculated that this substitution, or others found in different S protein sequences, could affect antibody recognition. In cryo-EM structures of the prefusion S trimer (Walls et al., 2020; Wrapp et al., 2020) and in our C105-S complex (FIG. 21), S protein residue D614 is located in $S1^D$, where it makes contact with an adjacent protomer. To address whether the D614G mutation could affect binding of antibodies in COV21 and COV57 plasma samples, we marked the location of the D614 residues and other residues that were reported to mutate (Korber et al., 2020) on the COV21 and COV57 nsEMPEM reconstructions (FIGS. 22A and 22B) and on the C105-S cryo-EM structure (FIG. 22C). The RBD-binding COV21 Fab(s) and the C105 Fab are distant from residue D614 (FIGS. 22A and 22C). Therefore, if the COV21 reconstruction reflects the predominant epitope in the COV21 plasma, it is unlikely that antibodies elicited in the COV21 individual would be sensitive to the D614G substitution. Indeed, in the absence of large conformational changes, all anti-RBD antibodies, including C105 (Robbiani et al., 2020) and B38 (Wu et al., 2020c), would be unaffected by this substitution. Mutations in the SARS-CoV-2 RBD identified by genome sequencing also include N439K, V483A, and V367F (Tables S3,S4), but the affected residues are not within the epitopes of the COV21 Fab(s) (FIGS. 22A and 22B) or the C105 Fab (FIG. 22C), and residue 483 is disordered in unliganded S protein structures (Walls et al., 2020; Wrapp et al., 2020). The predominant epitope in the COV57 plasma is closer to S protein D614, but this residue appears to be outside of the binding interface. In addition, mutations in the $S1^A$ domain identified by genome sequencing (Tables S3,S4) reside outside of the COV57 Fab(s) epitope (FIGS. 22A and 22B). Thus in the absence of a major conformational change induced by mutation, the observed substitutions, particularly the D614G mutation, are unlikely to affect antibodies elicited in the COV21 or COV57 individuals or in RBD-binding antibodies such as C105.

S protein epitopes offer different possibilities for avidity effects during IgG and receptor binding. IgGs contain two identical antigen-binding Fabs, thus offering the opportunity to bind pathogens with regularly-spaced antigen sites using avidity effects, either through inter-spike crosslinking (binding the same epitope on adjacent spikes) and/or intra-spike crosslinking (binding the same epitope on identical subunits of a single multimeric spike) (Klein and Bjorkman, 2010).

To address whether inter-spike crosslinking by anti-SARS-CoV-2 IgGs could occur, we modeled adjacent S proteins on a virion membrane assuming a minimum inter-spike separation distance of ~15 nm, as observed from cryo-electron tomography analyses of SARS-CoV and other coronaviruses (Neuman et al., 2011). By including a bound Fab on each S trimer in the position of the COV21 Fab(s) from the nsEMPEM reconstruction, we addressed whether the Fabs from a single IgG could bind to two adjacent S trimers. The modeling predicts that inter-spike crosslinking could occur for the COV21 epitope (FIG. 23A). By contrast, the downward-pointing Fab(s) in the COV57-S nsEMPEM reconstruction appear unlikely to participate in inter-spike crosslinking by an IgG due to the Fab orientations being unable to accommodate an Fc in a position that could join two Fabs (FIG. 23A). These predictions are consistent with ELISA results demonstrating diminished binding for COV21 Fabs compared with their IgG counterparts, but less pronounced differences for the Fab versus IgG comparison for COV57 (FIG. 18).

We also used modeling to predict whether avidity effects could influence the interaction between ACE2, an integral membrane protein that dimerizes on the target cell surface (Yan et al., 2020), with viral S trimers. Starting with a cryo-EM structure of dimeric full-length ACE2 associated with the integral membrane protein B$^O$AT1 bound to monomeric SARS-CoV-2 RBDs, we modeled bound S trimers from a cryo-EM structure of SARS-CoV S trimers with two RBDs in an "up" position (Kirchdoerfer et al., 2018). Assuming that there are adjacent ACE2-B$^O$AT1 complexes in the host cell membrane, the modeling predicts that inter-spike crosslinking is possible (FIG. 23B). Assuming rotation of the RBDs in a two "up"/one "down" S trimer, intra-spike cross-linking could also occur (FIG. 23C). If S trimers can indeed crosslink adjacent ACE2 receptors or bind as a single trimer to both ACE2 subunits in an ACE2 dimer, they could take advantage of avidity effects to bind more tightly than predicted from affinity measurements involving the interactions of monomeric ACE2 ectodomains to monomeric coronavirus RBDs (Shang et al., 2020; Walls et al., 2020; Wrapp et al., 2020).

The possibility of avidity effects during the interactions of SARS-CoV-2 S with ACE2 dimers has implications for interpretation of pseudovirus assays to measure coronavirus infectivity in the presence and absence of potential inhibitors such as antibodies. In vitro neutralization assays for SARS-CoV-2 include pseudoviruses based on HIV lentiviral particles (Chen et al., 2020; Crawford et al., 2020; Ou et al., 2020; Robbiani et al., 2020; Wu et al., 2020a), murine leukemia virus retroviral particles (Pinto et al., 2020; Quinlan et al., 2020), and vesicular stomatitis virus (Hoffmann et al., 2020; Nie et al., 2020; Xiong et al., 2020). Each of these pseudovirus types could potentially incorporate different numbers of spikes, in which case the overall spike density would alter sensitivity to antibody avidity. In any case, the effects of avidity on IgG binding to a tethered antigen are a complicated mixture of intrinsic Fab-antigen affinity, kinetics, input concentration, and incubation time (Klein and Bjorkman, 2010; Wu et al., 2005), thus neutralization potencies of some, but not all, IgGs could be affected in in vitro neutralization assays. In addition, when considering therapeutic applications of convalescent plasma or purified antibodies, avidity effects would be difficult to predict given uncertainties about antibody concentrations, viral titers, and potentially different S trimer spacings and densities on infectious virions.

The results, as presented above, provide a glimpse into diverse antibody responses in neutralizing plasmas from donors who recovered from COVID-19. We characterized polyclonal plasma IgGs that exhibited different degrees of cross-reactive binding between S proteins from SARS-CoV-2, SARS-CoV, and MERS-CoV and showed that the plasma IgGs also included non-cross-reactive antibodies against common cold virus RBDs. By mapping SARS-CoV-2 S epitopes targeted by convalescent plasma IgGs, we not only observed the expected targeting of the S protein RBD, but also discovered an epitope outside of the RBD, which may represent an alternative binding site for neutralizing antibodies. The RBD-binding Fab(s) from COV21 plasma resembled binding of S230, a VH3-30 mAb isolated from a SARS-CoV patient that blocks ACE2 receptor binding (Rockx et al., 2008). We found another type of ACE2 receptor-blocking anti-SARS-CoV-2 antibody in our analysis of a neutralizing mAb derived from the COV107 individual. In a 3.4 cryo-EM structure SARS-CoV-2 S protein bound to this mAb, C105, we observed an epitope on the RBD that overlapped with the binding site for COV21 Fab(s) and closely resembled the binding of another mAb, B38 (Wu et al., 2020c). Like C105, B38 is also derived from the VH3-53 VH gene segment. Our structural studies support the hypothesis that recurrent classes of anti-SARS-CoV-2 neutralizing antibodies derived from the VH3-53/VH3-66 and VH3-30 gene segments use the distinct RBD-binding modes of the B38/C105 and S230 mAbs, respectively, providing valuable information for evaluating antibodies raised by infection or vaccination by sequences alone. Finally, the RBD and $S1^A$ epitopes we mapped by nsEMPEM and single-particle cryo-EM are unlikely to be affected by common mutations in different SARS-CoV-2 isolates, offering hope that antibody therapeutics and/or a vaccine might be effective in combatting the current pandemic.

TABLE 1

Cohort characteristics

| Gender | Average n | Average age | Case/ Contact | Sx total | Average duration Sx onset to visit | Average Sx Severity (0-10) | ELISA binding (AUC) RBD IgG | IgM | S IgG | IgM | Neutralization (NT50) |
|---|---|---|---|---|---|---|---|---|---|---|---|
| Male | 83 | 45 (19-76) | 65/18 | 12 (0-31) | 39 (21-63) | 5.8 (0-10) | 2.44 | 1.61 | 4.65 | 1.62 | 867 |
| Female | 66 | 42 (19-75) | 46/20 | 12 (1-35) | 38 (17-67) | 5.4 (1-9) | 1.99 | 1.58 | 4.36 | 1.86 | 522 |

Sx = symptoms

TABLE 2

Individual participant demographics and clinical characteristics

| ID | Age | Gender | Race | Ethnicity | Case/ Contact | Sx total | Duration (days) Sx onset to visit | Sx Severity (0-10) | ELISA binding (AUC) RBD IgG | IgM | S IgG | IgM | Neutralization (NT50) |
|---|---|---|---|---|---|---|---|---|---|---|---|---|---|
| 5 | 43 | M | White | Non-Hispanic | Case | 9 | 41 | 9 | 2.52 | 2.35 | 5.51 | 2.43 | 5.0 |
| 7 | 40 | M | White | Non-Hispanic | Case | 11 | 30 | 6 | 2.92 | 2.54 | 7.39 | 2.37 | 2730.4 |

TABLE 2-continued

Individual participant demographics and clinical characteristics

| ID | Age | Gender | Race | Ethnicity | g p p p Case/ Contact | Duration (days) Sx total | Sx onset to visit | Sx Severity (0-10) | ELISA binding (AUC) RBD IgG | IgM | S IgG | IgM | Neutralization (NT50) |
|---|---|---|---|---|---|---|---|---|---|---|---|---|
| 8 | 37 | M | White | Non-Hispanic | Case | 3 | 57 | 5 | 2.11 | 0.81 | 4.46 | 0.88 | 5.0 |
| 9 | 35 | F | White | Non-Hispanic | Case | 12 | 54 | 5 | 2.90 | 1.07 | 4.44 | 2.80 | 5.0 |
| 12 | 27 | F | White | Non-Hispanic | Contact | 7 | 24 | 3 | 1.47 | 1.71 | 4.31 | 1.23 | 5.0 |
| 13 | 28 | M | White | Non-Hispanic | Case | 5 | 25 | 3 | 1.97 | 4.10 | 3.95 | 1.38 | 173.2 |
| 18 | 55 | M | White | Non-Hispanic | Case | 16 | 28 | 6 | 2.57 | 1.75 | 3.92 | 1.31 | 410.3 |
| 20 | 26 | F | White | Non-Hispanic | Case | 2 | 17 | 5 | 1.80 | 2.00 | 4.49 | 1.68 | 5.0 |
| 21 | 54 | M | White | Hispanic | Contact | 11 | 27 | 7 | 5.60 | 2.88 | 7.60 | 2.47 | 5052.7 |
| 24 | 34 | M | White | Non-Hispanic | Case | 15 | 30 | 4 | 2.29 | 1.97 | 4.36 | 1.45 | 280.7 |
| 26 | 66 | M | White | Non-Hispanic | Case | 2 | 35 | 3 | 1.67 | 1.86 | 4.00 | 1.58 | 276.1 |
| 27 | 26 | M | White | Non-Hispanic | Case | 9 | 32 | 4 | 1.79 | 1.64 | 4.41 | 1.30 | 739.3 |
| 28 | 26 | M | White | Non-Hispanic | Case | 7 | 21 | 4 | 2.39 | 2.25 | 4.93 | 1.66 | 888.9 |
| 29 | 26 | F | White | Non-Hispanic | Contact | 5 | 35 | 4 | 1.69 | 1.54 | 3.93 | 1.97 | 5.0 |
| 30 | 30 | M | White | Non-Hispanic | Contact | 3 | 35 | 4 | 3.07 | 2.55 | 4.86 | 1.34 | 5.0 |
| 31 | 51 | M | White | Non-Hispanic | Case | 9 | 33 | 3 | 1.29 | 1.60 | 4.69 | 1.20 | 192.3 |
| 32 | 46 | F | White | Non-Hispanic | Case | 8 | 32 | 3 | 1.30 | 2.18 | 3.79 | 0.83 | 47.4 |
| 37 | 27 | M | White | Non-Hispanic | Case | 6 | 26 | 6 | 2.13 | 1.52 | 4.11 | 1.04 | 286.3 |
| 38 | 57 | F | White | Non-Hispanic | Case | 10 | 38 | 4 | 1.87 | 2.02 | 4.30 | 1.12 | 518.9 |
| 40 | 44 | M | White | Non-Hispanic | Case | 7 | 23 | 5 | 1.72 | 1.50 | 3.81 | 1.47 | 42.1 |
| 41 | 35 | M | White | Non-Hispanic | Contact | 10 | 29 | 8 | 2.13 | 1.67 | 4.15 | 0.98 | 302.5 |
| 42 | 40 | M | White | Non-Hispanic | Contact | 20 | 36 | 8 | 2.37 | 1.50 | 5.82 | 1.43 | 627.1 |
| 45 | 55 | F | White | Non-Hispanic | Case | 7 | 46 | 6 | 1.95 | 0.97 | 3.53 | 0.75 | 5.0 |
| 46 | 39 | M | White | Non-Hispanic | Case | 6 | 30 | 2 | 2.68 | 1.45 | 4.14 | 1.29 | 59.2 |
| 47 | 43 | F | White | Non-Hispanic | Case | 11 | 33 | 5 | 3.02 | 2.30 | 6.23 | 2.66 | 10433.3 |
| 46 | 37 | F | White | Non-Hispanic | Case | 7 | 21 | 5 | 1.51 | 1.85 | 3.47 | 1.51 | 173.4 |
| 50 | 27 | F | White | Non-Hispanic | Contact | 7 | 28 | 4 | 1.64 | 2.32 | 5.42 | 1.45 | 924.7 |
| 51 | 21 | M | White | Non-Hispanic | Contact | 8 | 31 | 5 | 1.76 | 1.69 | 3.94 | 1.03 | 1499.2 |
| 54 | 40 | F | White | Non-Hispanic | Contact | 3 | 24 | 3 | 1.80 | 2.10 | 4.99 | 1.42 | 5.0 |
| 55 | 36 | M | White | Non-Hispanic | Case | 3 | 49 | 2 | 1.43 | 1.23 | 3.90 | 2.09 | 5.0 |
| 56 | 75 | F | White | Non-Hispanic | Case | 22 | 40 | 3 | 1.79 | 1.81 | 5.89 | 1.47 | 1388.4 |
| 57 | 66 | M | White | Non-Hispanic | Case | 6 | 21 | 5 | 1.54 | 2.10 | 4.33 | 1.00 | 2048.9 |
| 58 | 64 | F | White | Non-Hispanic | Contact | 1 | 32 | 2 | 1.20 | 1.71 | 3.95 | 1.21 | 5.0 |
| 64 | 28 | F | White | Non-Hispanic | Contact | 11 | 32 | 6 | 2.36 | 2.06 | 4.48 | 1.66 | 776.7 |
| 67 | 19 | F | N/A | Hispanic | Case | 5 | 29 | 6 | 2.56 | 1.98 | 5.48 | 1.32 | 2052.9 |
| 71 | 45 | F | White | Non-Hispanic | Case | 12 | 48 | 7 | 1.55 | 2.04 | 3.86 | 1.53 | 33.3 |
| 72 | 42 | M | White | Non-Hispanic | Case | 16 | 35 | 8 | 4.05 | 3.58 | 6.05 | 2.59 | 3136.2 |
| 75 | 46 | F | White | Non-Hispanic | Case | 10 | 36 | 4 | 1.64 | 2.37 | 3.98 | 1.20 | 271.5 |
| 76 | 49 | F | White | Non-Hispanic | Case | 28 | 34 | 4 | 1.88 | 1.65 | 5.17 | 0.97 | 219.8 |
| 77 | 37 | M | White | Non-Hispanic | Contact | 6 | 33 | 4 | 1.33 | 1.83 | 3.56 | 1.16 | 5.0 |
| 81 | 44 | F | White | Non-Hispanic | Contact | 3 | 35 | 2 | 1.58 | 1.73 | 3.82 | 1.10 | 5.0 |
| 82 | 46 | M | N/A | Non-Hispanic | Case | 0 | | 0 | 2.19 | 1.92 | 5.41 | 1.81 | 130.7 |
| 88 | 41 | M | White | Non-Hispanic | Case | 7 | 23 | 4 | 1.82 | 3.32 | 4.97 | 1.37 | 424.7 |
| 95 | 44 | M | White | Non-Hispanic | Case | 9 | 36 | 6 | 2.61 | 1.62 | 6.03 | 1.62 | 961.9 |
| 96 | 48 | F | White | Non-Hispanic | Case | 9 | 30 | 3 | 3.93 | 1.93 | 6.25 | 2.26 | 927.7 |
| 97 | 39 | M | White | Non-Hispanic | Case | 9 | 31 | 3 | 1.58 | 1.61 | 4.03 | 2.33 | 202.7 |
| 98 | 35 | F | White | Non-Hispanic | Case | 2 | 24 | 4 | 1.78 | 1.47 | 5.38 | 1.22 | 249.0 |
| 99 | 36 | F | White | Non-Hispanic | Case | 13 | 29 | 5 | 2.50 | 3.27 | 4.38 | 2.49 | 1127.6 |
| 107 | 53 | F | White | Non-Hispanic | Contact | 10 | 29 | 4 | 1.74 | 1.41 | 4.66 | 0.90 | 297.5 |
| 108 | 75 | M | White | Non-Hispanic | Case | 16 | 41 | 7 | 1.37 | 0.88 | 3.47 | 1.36 | 557.5 |
| 110 | 27 | M | White | Non-Hispanic | Case | 1 | 25 | 1 | 1.30 | 1.60 | 4.00 | 0.93 | 5.0 |
| 114 | 30 | F | White | Non-Hispanic | Case | 15 | 36 | 7 | 1.65 | 1.92 | 3.53 | 1.55 | 110.9 |
| 115 | 65 | F | White | Non-Hispanic | Contact | 20 | 41 | 6 | 2.10 | 3.28 | 4.32 | 3.27 | 1127.7 |
| 119 | 56 | M | White | Non-Hispanic | Case | 13 | 48 | 3 | 1.36 | 1.26 | 4.41 | 1.59 | 650.3 |
| 120 | 56 | F | White | Non-Hispanic | Case | 26 | 48 | 6 | 0.99 | 0.97 | 3.65 | 1.21 | 100.6 |
| 121 | 19 | M | White | Non-Hispanic | Case | 3 | 42 | 2 | 0.85 | 0.87 | 3.56 | 1.26 | 5.0 |
| 122 | 21 | F | White | Non-Hispanic | Contact | 3 | 36 | 1 | 1.44 | 0.94 | 3.39 | 1.22 | 5.0 |
| 123 | 26 | M | White | Non-Hispanic | Contact | 12 | 34 | 6 | 0.94 | 0.95 | 3.39 | 1.40 | 5.0 |
| 124 | 63 | F | Asian | Non-Hispanic | Contact | 4 | 37 | 3 | 1.58 | 2.06 | 3.49 | 1.32 | 5.0 |
| 125 | 51 | F | White | Non-Hispanic | Case | 10 | 26 | 3 | 1.92 | 3.49 | 3.86 | 1.24 | 126.5 |
| 127 | 24 | F | White | Non-Hispanic | Case | 10 | 43 | 6 | 1.80 | 2.50 | 4.37 | 2.41 | 883.5 |
| 130 | 39 | M | White | Non-Hispanic | Contact | 7 | 26 | 5 | 1.24 | 1.72 | 3.91 | 1.34 | 5.0 |
| 131 | 39 | M | White | Non-Hispanic | Case | 5 | 25 | 4 | 1.46 | 1.38 | 4.44 | 1.03 | 7.8 |
| 132 | 36 | M | White | Non-Hispanic | Case | 10 | 50 | 6 | 2.15 | 1.76 | 4.84 | 1.97 | 5.0 |
| 134 | 27 | F | White | Non-Hispanic | Contact | 16 | 22 | 5 | 2.51 | 2.18 | 6.84 | 1.94 | 2700.6 |
| 135 | 62 | F | White | Non-Hispanic | Case | 8 | 31 | 6 | 2.20 | 2.02 | 3.80 | 1.13 | 350.0 |
| 140 | 63 | F | White | Non-Hispanic | Case | 28 | 47 | 1 | 1.05 | 1.24 | 3.58 | 1.28 | 52.4 |
| 149 | 41 | M | White | Non-Hispanic | Case | 17 | 28 | 6 | 1.68 | 2.02 | 3.67 | 1.09 | 494.9 |
| 150 | 50 | F | White | Non-Hispanic | Contact | 12 | 45 | 7 | 1.15 | 0.43 | 3.18 | 1.82 | 5.0 |
| 154 | 66 | M | Asian | Non-Hispanic | Case | 16 | 30 | 9 | 3.19 | 2.19 | 4.85 | 1.29 | 928.2 |
| 157 | 50 | M | White | Non-Hispanic | Case | 10 | 32 | 8 | 2.40 | 2.86 | 3.90 | 2.06 | 741.7 |
| 166 | 28 | F | White | Non-Hispanic | Case | 13 | 45 | 2 | 1.27 | 0.66 | 3.45 | 0.94 | 5.0 |
| 167 | 50 | F | White | Non-Hispanic | Contact | 11 | 41 | 6 | 1.43 | 3.71 | 3.93 | 8.74 | 5.0 |

TABLE 2-continued

Individual participant demographics and clinical characteristics

| | | | | | | Duration (days) | | Sx | ELISA binding (AUC) | | | | |
|---|---|---|---|---|---|---|---|---|---|---|---|---|---|
| | | | | | g p | | | | RBD | | S | | |
| | | | | p p | Case/ | Sx | Sx onset | Severity | | | | | Neutralization |
| ID | Age | Gender | Race | Ethnicity | Contact | total | to visit | (0-10) | IgG | IgM | IgG | IgM | (NT50) |
| 172 | 36 | F | White | Non-Hispanic | Case | 6 | 22 | 9 | 1.71 | 2.58 | 4.29 | 1.20 | 301.1 |
| 173 | 47 | M | White | Non-Hispanic | Case | 5 | 47 | 7 | 2.57 | 4.14 | 4.78 | 4.48 | 646.9 |
| 178 | 26 | F | White | Non-Hispanic | Case | 6 | 24 | 4 | 1.54 | 1.59 | 3.66 | 1.02 | 5.0 |
| 179 | 39 | M | White | Non-Hispanic | Contact | 10 | 37 | 3 | 1.89 | 2.25 | 3.83 | 1.73 | 370.1 |
| 182 | 44 | F | White | Non-Hispanic | Contact | 10 | 38 | 6 | 3.80 | 1.77 | 5.36 | 8.05 | 1503.7 |
| 183 | 43 | F | White | Non-Hispanic | Case | 13 | 44 | 8 | 1.56 | 1.02 | 3.88 | 1.55 | 240.1 |
| 185 | 54 | M | White | Non-Hispanic | Case | 11 | 44 | 8 | 3.51 | 1.39 | 5.55 | 2.11 | 1806.8 |
| 186 | 38 | F | N/A | N/A | Case | 8 | 26 | 2 | 1.73 | 2.47 | 4.37 | 1.23 | 296.9 |
| 190 | 54 | F | White | Non-Hispanic | Case | 18* | 63 | 9 | 3.24 | 1.24 | 7.38 | 1.42 | 598.1 |
| 195 | 24 | M | White | Non-Hispanic | Case | 18 | 42 | 5 | 2.74 | 2.55 | 5.01 | 2.33 | 1315.1 |
| 200 | 60 | F | White | Non-Hispanic | Case | 17 | 39 | 7 | 2.40 | 1.00 | 4.38 | 1.51 | 1014.4 |
| 201 | 50 | M | White | Non-Hispanic | Contact | 15 | 33 | 6 | 4.37 | 2.87 | 6.15 | 1.57 | 3897.4 |
| 202 | 57 | M | White | Non-Hispanic | Case | 21 | 34 | 7 | 2.10 | 2.08 | 5.07 | 1.17 | 257.9 |
| 205 | 64 | M | White | Non-Hispanic | Case | 7 | 36 | 4 | 4.51 | 0.70 | 6.12 | 1.69 | 924.4 |
| 222 | 28 | M | Asian | Non-Hispanic | Case | 11 | 29 | 7 | 1.28 | 0.69 | 3.94 | 3.46 | 5.0 |
| 229 | 45 | M | White | Non-Hispanic | Case | 10 | 63 | 4 | 2.92 | 1.42 | 4.90 | 1.58 | 1272.9 |
| 230 | 50 | M | White | Non-Hispanic | Case | 18 | 33 | 7 | 3.80 | 0.47 | 3.48 | 0.88 | 5.0 |
| 232 | 38 | F | White | Non-Hispanic | Case | 13 | 43 | 7 | 1.57 | 0.70 | 4.24 | 5.70 | 94.3 |
| 233 | 55 | M | White | Non-Hispanic | Case | 20 | 41 | 3 | 2.07 | 2.11 | 4.51 | 1.07 | 173.2 |
| 241 | 36 | M | White | Non-Hispanic | Case | 12 | 30 | 7 | 2.27 | 2.66 | 4.54 | 1.46 | 923.1 |
| 242 | 59 | M | White | Non-Hispanic | Case | 10 | 42 | 6 | 4.91 | 1.94 | 4.81 | 2.16 | 1353.0 |
| 243 | 30 | F | Asian | Non-Hispanic | Case | 6 | 26 | 5 | 2.92 | 2.57 | 5.06 | 1.14 | 1300.2 |
| 246 | 44 | F | White | Non-Hispanic | Case | 10 | 38 | 7 | 2.05 | 2.79 | 6.09 | 1.32 | 566.0 |
| 255 | 33 | M | White | Non-Hispanic | Case | 14 | 44 | 6 | 2.14 | 0.70 | 4.20 | 1.24 | 172.5 |
| 256 | 63 | F | White | Non-Hispanic | Case | 27 | 42 | 6 | 1.72 | 1.96 | 4.26 | 7.79 | 141.6 |
| 258 | 52 | M | White | Non-Hispanic | Contact | 14 | 48 | 6 | 2.64 | 1.20 | 4.52 | 1.85 | 4145.9 |
| 279 | 41 | M | White | Non-Hispanic | Case | 7 | 38 | 8 | 1.68 | 2.13 | 3.77 | 1.90 | 308.9 |
| 280 | 59 | M | White | Non-Hispanic | Case | 6 | 32 | 7 | 2.53 | 3.07 | 4.61 | 1.19 | 1072.1 |
| 302 | 47 | F | White | Non-Hispanic | Case | 35* | 49 | 7 | 1.48 | 0.97 | 4.06 | 1.26 | 5.0 |
| 310 | 34 | F | White | Non-Hispanic | Case | 17 | 35 | 5 | 3.95 | 1.24 | 9.44 | 3.07 | 485.5 |
| 314 | 46 | M | White | Non-Hispanic | Case | 11 | 38 | 7 | 2.12 | 0.88 | 4.56 | 1.51 | 667.1 |
| 315 | 29 | F | White | Non-Hispanic | Case | 15 | 42 | 8 | 3.02 | 0.69 | 3.98 | 1.03 | 376.5 |
| 319 | 50 | M | White | Non-Hispanic | Case | 5 | 38 | 6 | 3.71 | 2.28 | 3.79 | 1.05 | 5.0 |
| 323 | 39 | F | White | Non-Hispanic | Case | 7 | 45 | 7 | 1.05 | 1.03 | 3.53 | 1.42 | 5.0 |
| 325 | 52 | M | White | Non-Hispanic | Case | 16 | 38 | 8 | 2.25 | 1.47 | 4.83 | 2.28 | 1603.3 |
| 343 | 21 | F | White | Non-Hispanic | Case | 16 | 49 | 5 | 1.63 | 0.94 | 3.37 | 1.70 | 5.0 |
| 352 | 44 | M | White | Non-Hispanic | Case | 16 | 43 | 4 | 3.54 | 0.92 | 4.50 | 1.07 | 519.2 |
| 353 | 60 | M | White | Non-Hispanic | Case | 14 | 49 | 6 | 5.38 | 1.12 | 5.69 | 1.05 | 855.5 |
| 356 | 22 | F | White | Non-Hispanic | Contact | 16 | 38 | 3 | 1.37 | 0.61 | 2.98 | 1.09 | 5.0 |
| 357 | 27 | F | White | Non-Hispanic | Contact | 34 | 56 | 5 | 7.49 | 1.10 | 2.77 | 1.13 | 5.0 |
| 364 | 29 | M | White | Non-Hispanic | Case | 14 | 49 | 6 | 0.97 | 0.58 | 2.90 | 0.89 | 5.0 |
| 366 | 41 | F | White | Non-Hispanic | Contact | 9 | 34 | 7 | 0.98 | 0.52 | 3.51 | 1.19 | 5.0 |
| 373 | 35 | F | White | Non-Hispanic | Case | 12 | 51 | 7 | 1.69 | 1.26 | 5.14 | 1.69 | 5.0 |
| 388 | 47 | F | White | Non-Hispanic | Contact | 14 | 41 | 9 | 1.57 | 1.06 | 3.61 | 1.69 | 5.0 |
| 393 | 69 | M | White | Non-Hispanic | Case | 23* | 54 | 9 | 1.28 | 1.74 | 3.81 | 2.65 | 715.4 |
| 394 | 48 | F | Multiple | Hispanic | Case | 7 | 67 | 4 | 2.05 | 0.87 | 4.34 | 2.02 | 1281.5 |
| 397 | 52 | M | White | Non-Hispanic | Case | 22 | 45 | 8 | 3.32 | 0.59 | 5.01 | 0.87 | 1516.9 |
| 403 | 52 | M | Asian | Non-Hispanic | Case | 18* | 39 | 10 | 5.36 | 1.09 | 10.01 | 1.36 | 3887.8 |
| 406 | 65 | M | White | Non-Hispanic | Case | 20 | 56 | 8 | 4.69 | 0.90 | 7.51 | 1.15 | 1288.7 |
| 410 | 34 | M | White | Non-Hispanic | Case | 12 | 46 | 8 | 1.06 | 0.56 | 3.95 | 0.76 | 5.0 |
| 421 | 62 | F | White | Non-Hispanic | Contact | 12 | 43 | 9 | 0.95 | 1.07 | 3.34 | 1.35 | 5.0 |
| 426 | 65 | M | White | Non-Hispanic | Case | 18 | 51 | 6 | 2.07 | 0.55 | 3.95 | 1.49 | 804.8 |
| 437 | 43 | F | Asian | Non-Hispanic | Case | 14 | 34 | 7 | 2.54 | 0.47 | 4.30 | 1.44 | 698.8 |
| 460 | 36 | M | White | Non-Hispanic | Case | 11 | 39 | 6 | 2.94 | 3.18 | 5.51 | 2.80 | 1906.7 |
| 461 | 49 | M | White | Non-Hispanic | Case | 7 | 39 | 5 | 3.38 | 0.94 | 4.67 | 2.02 | 1076.6 |
| 462 | 28 | F | White | Non-Hispanic | Case | 16 | 45 | 5 | 1.36 | 0.38 | 3.07 | 1.11 | 5.0 |
| 470 | 28 | F | White | Non-Hispanic | Case | 17 | 51 | 4 | 1.26 | 0.86 | 3.97 | 1.50 | 5.0 |
| 478 | 31 | M | White | Non-Hispanic | Case | 16 | 52 | 4 | 1.43 | 0.93 | 3.70 | 1.97 | 263.2 |
| 481 | 28 | F | Asian | Non-Hispanic | Case | 15 | 43 | 8 | 1.70 | 0.39 | 3.46 | 1.24 | 5.0 |
| 486 | 64 | F | White | Non-Hispanic | Case | 11 | 41 | 10 | 1.70 | 1.00 | 3.68 | 1.29 | 5.0 |
| 500 | 46 | M | White | Non-Hispanic | Case | 12 | 53 | 5 | 1.10 | 0.82 | 3.49 | 1.34 | 5.0 |
| 501 | 32 | M | Asian | Non-Hispanic | Case | 18* | 53 | 10 | 2.62 | 0.65 | 4.51 | 1.21 | 718.8 |
| 502 | 52 | M | White | Non-Hispanic | Case | 16* | 53 | 9 | 5.10 | 0.61 | 5.10 | 1.62 | 2171.8 |
| 506 | 46 | M | White | Non-Hispanic | Case | 12 | 59 | 9 | 0.84 | 0.81 | 3.13 | 1.21 | 5.0 |
| 507 | 39 | M | White | Non-Hispanic | Case | 15 | 60 | 8 | 1.92 | 0.96 | 4.56 | 1.52 | 5.0 |
| 509 | 36 | M | White | Non-Hispanic | Case | 11 | 50 | 5 | 1.99 | 1.01 | 3.99 | 1.45 | 5.0 |
| 526 | 49 | M | Asian | Non-Hispanic | Case | 11 | 34 | 7 | 3.36 | 1.45 | 5.88 | 1.57 | 4193.3 |
| 537 | 52 | M | White | Non-Hispanic | Case | 15 | 45 | 6 | 1.47 | 0.95 | 3.65 | 1.58 | 923.3 |
| 539 | 73 | F | White | Non-Hispanic | Case | 19* | 54 | 10 | 2.82 | 0.63 | 4.46 | 1.45 | 487.9 |
| 547 | 59 | M | White | Non-Hispanic | Case | 15* | 36 | 9 | 2.97 | 1.53 | 5.08 | 2.59 | 2900.6 |
| 587 | 54 | M | PI | N/A | Case | 17* | 51 | 8 | 3.22 | 0.60 | 4.01 | 1.49 | 473.1 |

TABLE 2-continued

Individual participant demographics and clinical characteristics

| ID | Age | Gender | Race | Ethnicity | Case/Contact | Sx total | Sx onset to visit | Severity (0-10) | ELISA binding (AUC) RBD IgG | RBD IgM | S IgG | S IgM | Neutralization (NT50) |
|---|---|---|---|---|---|---|---|---|---|---|---|---|---|
| 632 | 38 | M | White | Non-Hispanic | Contact | 10 | 43 | 6 | 2.49 | 0.86 | 4.50 | 1.63 | 572.3 |
| 633 | 39 | M | White | Non-Hispanic | Contact | 8 | 57 | 4 | 1.25 | 1.04 | 3.38 | 1.73 | 5.0 |
| 652 | 76 | M | White | Non-Hispanic | Case | 18* | 56 | 10 | 4.75 | 1.46 | 8.96 | 3.80 | 2324.0 |
| 664 | 45 | F | White | Non-Hispanic | Case | 17* | 42 | 10 | 1.68 | 0.43 | 3.93 | 1.32 | 5.0 |
| 675 | 47 | M | White | Non-Hispanic | Contact | 31 | 47 | 5 | 0.79 | 0.93 | 2.94 | 1.38 | 5.0 |

*hospitalized,
Sx = symptoms

| Symptom | Participants (n = 149) | % |
|---|---|---|
| Fever | 125 | 83.9 |
| Fatigue | 106 | 71.1 |
| Cough | 93 | 62.4 |
| Myalgia | 92 | 61.7 |
| Shortness of breath | 66 | 44.3 |
| Headache | 63 | 42.3 |
| Loss of smell/taste | 50 | 33.3 |
| Sore throat | 38 | 25.3 |
| Diarrhea | 32 | 21.3 |
| Presence of comorbidities (HTN, CAD, DM, COPD, asthma, cancer) | 16 | 10.7 |

HTN (hypertension),
CAD (coronary artery disease),
DM (diabetes mellitus),
COPD (chronic obstructive pulmonary disease)

TABLE 4

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C002 | A-C002 | 1 | EVQLVESGGGVVQPGRSLRLSCAASGFTFSIYGMHWVRQAPGKGLEWAVISYDGSNKYYADSVKGRFTISRDNSKNTLYLQMNSLRAEDTAVYYCAKEGRPSDIVVVVAFDYWGQGTLVTVSS | 2 | DIQLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK |
| C003 | A-C003 | 3 | EVQLVESGGGLIQPGGSLRLSCAASGFTVSSNYMSWVRQAPGKGLEWVSVIYSGGSTYYADSVKGRFTISRDNSKNTLYLQMNSLRAGDTAVYYCARDYGDFYFDYWGQGTLVTVSS | 4 | EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKLEIK |
| C004 | A-C004 | 5 | QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS | 6 | AIRMTQSPSSLSASVGDRVTITCQASQDISNYLNWYQQKPGKAPKLLIYDASNLETGVPSRFSGSGSGTDFFTISSLQPEDIATYYCQQYDNLPITFGQGTRLEIK |
| C005 | A-C005 | 7 | QVQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS | 8 | EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPWTFGQGTKVEIK |
| C006 | A-C006 | 9 | QVQLVESGGGLVKPGGSLRLSCAASGFIFSDYCMSWIRRAPGKGLEWLSYISNSGTTRYYADSVKGRFTISRDNGRNSLYLQMDSLSAEDTAVYYCARRGDGSSSIYYYNYMDVWGKGTTVTVSS | 10 | QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVL |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C008 | A-C008 | 11 | EVQLVESGGGVVQPGRSLRLSCAASGFTSSYGMHWVRQAPGKGLEWVTVISYDGRNKYYADSVKGRFTISRDNSKNTLYLQMNSLRAEDTAVYYCAREFGDPEWYFDYWGQGTLVTVSS | 12 | DIQMTQSPSTLSASVGDRVTITCRANQSISSWLAWYQQKPGKAPKLLIYKASSLESGVPSRFSGSGSGTEFTLTISSLQPDDFATYYCQQYNSYWTFGQGTKVEIK |
| C009 | A-C009 | 13 | QVQLVQSGAEVKKPGASVKVSCMASGYTFTGYYMHWVRQAPGQGLEWMGWINPNSGGTNYAQKFQGRVTMTRDTSISTAYMELSRLRSDDTAVYYCARDSPFSALGASNDYWGQGTLVTVSS | 14 | QSALTQPPSASGSPGQSVTISCTGTSSDVGGYNYVSWYQQHPGKAPKLMIYEVSKRPSGVPDRFSGSKSGNTASLTVSGLQAEDEAEYYCSSDAGSNNVVFGGGTKLTVL |
| C010 | A-C010 | 15 | EVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS | 16 | DIQLTQSPSSLSASVGDRVTITCRASQSISTYLNWYQQKPGKAPKLLIYAASSLQSGVPSRFSGSGSGTDFTLTISSLQPEDFATYYCQQSYSTPPWTFGQGTKVEIK |
| C013 | A-C013 | 17 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNRLLYCSSTSCYLDAVRQGYYYYYYMDVWGKGTTVTVSS | 18 | EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK |
| C016 | A-C016 | 19 | EVQLVESGGGVVQPGRSLRLSCAASGFTFSRYGMHWVRQAPGKGLEWVAVISYDGSNKYYADSVKGRFTISRDNSKNTLYLQMNSLRAEDTAVYYCAKVTAPYCSGGSCYGGNFDYWGQGTLVTVSS | 20 | AIRMTQSPSSLSASVGDRVTITCQASQDISNYLNWYQQKPGKAPKLLIYDASNLETGVPSRFSGSGSGTDFTFTINSLQPEDIATYYCQQYDNLPPTFGGGTKVEIK |
| C017 | A-C017 | 21 | EVQLVESGGGLVQPGRSLRLSCAASGFTFDDYAMHWVRQAPGKGLEWVSGISWNSGTIGYADSVKGRFTISRDNAKNSLYLQMNSLRAEDTAFYYCAKAGVRGIAAAGPDLNFDHWGQGTLVTVSS | 22 | EIVLTQSPATLSLSPGERATLSCRASQSVSSYLAWYQQKPGQAPRLLIYDASNRATGIPARFSGSGSGTDFTLTISSLEPEDFAVYYCQQRITFGQGTRLEIK |
| C018 | A-C018 | 23 | EVQLVESGGGVVQPGRSLRLSCAASGFTFSNYAIHWVRQAPGKGLEWVAVISYDGSNKYYADSVKGRFTISRDNSKNTLYLQMNSLRAEDTAVYYCARDFDDSSFWAFDYWGQGTLVTVSS | 24 | DIQLTQSPSSLSASVGDRVTITCRASQSIRSYLNWYQQKPGKAPKLLIYAASSLQSGVPSRFSGSGSGTDFTLTISSLQPDDFATYYCQQSYSTPPATFGQGTKLEIK |
| C019 | A-C019 | 25 | QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVPREGTPGFDPWGQGTLVTVSS | 26 | SYELTQPPSVSVAPGKTARITCGENNIGSKSVHWYQQKPGQAPVLVIYYDSDRPSGIPERFSGSNSGNTATLTINRVEAGDEADYYCQVWDSSSDHVVFGGGTKLTVL |
| C021 | A-C021 | 27 | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVWQYYDSSGSFDYWGQGTLVTVSS | 28 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK |
| C022 | A-C022 | 29 | QVQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS | 30 | DIQMTQSPSTLSASVGDSVTITCRASQSISSWLAWYQQKPGKAPKLLIYKASSLESGVPSRFSGSGSGTEFTLTISSLQPDDFATYYCQQYNNYRYTFGQGTKLEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C027 | A-C027 | 31 | EVQLVESGGGVVQPGRSLRLSCA ASGFTFSSYGMHWVRQAPGKGL EWVAVISYDGSNKYYADSVKGRF TISRDNSKNTLYLQMNSLRAEDTA VYYCAKASGIYCSGGDCYSYYFD YWGQGTLVTVSS | 32 | DIQMTQSPSTLSASVGDRVTITCR ASQSISSWLAWYQQKPGKAPKLLI YKASSLESGVPSRFSGSGSGTEFT LTISSLQPDDFATYYCQQYNSYST FGQGTKVEIK |
| C029 | A-C029 | 33 | QVQLQESGPGLVKPSQTLSLTCT VSGGSISSGGYYWSWIRQHPGK GLEWIGYIYYSGSTYYNPSLKSRV TISVDTSKNQFSLKLSSVTAADTA VYYCARTMYYYDSSGSFDYWGQ GTLVTVSS | 34 | DIVMTQSPLSLPVTPGEPASISCRS SQSLLHSNGYNYLDWYLQKPGQS PQLLIYLGSNRASGVPDRFSGSGS GTDFTLKISRVEAEDVGVYYCMQA LQTPHTFGGGTKVEIK |
| C030 | A-C030 | 35 | EVQLVESGGGVVQPGRSLRLSCA ASGFTFSSYGMHVWRQAPGKGL EWVAVISYDGSNKYYADSVKGRF TISRDNSKNTLYLQMNSLRAEDTA VYYCAKASGIYCSGGNCYSYYFD YWGQGTLVTVSS | 36 | DIQMTQSPSTLSASVGDRVTITCR ASQSISSWLAWYQQKPGKAPKLLI YKASSLESGVPSRFSGSGSGTEFT LTISSLQPDDFATYYCQQYNSYST FGQGTKVEIK |
| C031 | A-C031 | 37 | EVQLVESGGGLVQPGGSLRLSCA ASGFTFSSYDMHWVRQATGKGL EWVSAIGTAGDTYYPGSVKGRFTI SRENAKNSLYLQMNSLRAGDTAV YYCARVGYDSSGYSGWYFDLWG RGTLVTVSS | 38 | DIQMTQSPSSLSASVGDRVTITCR ASQSISSYLNWYQQKPGKAPKVLI YAASSLQSGVPSRFSGSGSGTDF TLTISSLQPEDFATYYCQQSYSTPP LTFGGGTKVEIK |
| C032 | A-C032 | 39 | EVQLVQSGAEVKKPGESLKISCK GSGYSFTSYWIGWVRQMPGKGL EWMGIIYPGDSDTRYSPSFQGQV TISADKSISTAYLQWSSLKASDTA MYYCARGVAVDWYFDLWGRGTL VTVSS | 40 | QSVLTQPPSVSGAPGQRVTISCTG SSSNIGAGYDVHWYQQLPGTAPK LLIYGNSNRPSGVPDRFSGSKSGT SASLAITGLQAEDEADYYCQSYDS SLSALYVFGTGTKVTVL |
| C036 | A-C036 | 41 | QVQLQQWGAGLLKPSETLSRTCA VFGGSFTNYYWSWIRQSPGKGLE WIGEINDSGITNYNPSLKSRVTISV DTSKNQFSLSLRSVTAADTAVYYC ARRRSFSRPSSIDYWGQGTLVTV SS | 42 | DIVMTQSPLSLPVTPGEPASISCRS SQSLLHRNGYNYLDWYLQKPGQS PQLLIYLGSNRASGVPDRFRGSGS GTDFTLKISRVEAEDVGVYYCMQA LQTLTFGQGTRLEIK |
| C037 | A-C037 | 43 | QLVQSGPEVKKPGTSVKVSCKAS GFTFTSSAMQWVRQARGQRLEW IGWIVVGSGNTNYAQKFQERVTIT RDMSTSTAYMELSSLRSEDTAVY YCAAPYCSGGSCNDAFDIWGQG TMVTVSS | 44 | EIVLTQSPGTLSLSPGERATLSCRA SQSVSSSYLAWYQQKPGQAPRLLI YGASSRATGIPDRFSGSGSGTDFT LTISRLEPEDFAVYYCQQYGSSPW TFGQGTKVEIK |
| C038 | A-C038 | 45 | VQLVESGGGVVQPGRSLRLSCAA SGFTFNRIAMYWVRQAPGKGLE WVAVISFDGSYEYYAESVKGRFAI SRDNSKNTLYLQMNSLRAEDTAV YYCAKSPMGYCTNGVCYPDSWG QGTLVTVSS | 46 | NFMLTQPHSVSESPGKTVTISCTG SSGSIASNYVQWYQQRPGSAPTT VIYEDTQRPSGVPDRFSGSIDSSS NSASLTISGLKTEDEADYYCQSYDI NSRWVFGGGTKLTVL |
| C040 | A-C040 | 47 | EVQLVESGGGLVKPGGSLRLSCA ASGFTFSNAWMSWVRQAPGKGL EWVGRIKSKTDGGTTDYAAPVKG RFTISRDDSKNTLYLQMNSLKTED TAVYYCTTDPHCSSTSCPIFYYYY MDVWGKGTTVTVSS | 48 | SYELTQPPSVSVAPGQTARITCGG NNIGSKSVHWYQQKPGQAPVLVV YDDSDRPSGIPERFSGSNSGNTAT LTISRVEAGDEADYYCQVWDSSSD QGVFGGGTKLTVL |
| C101 | V-C001 | 49 | QVQLVESGGGLIQPGGSLRLSCA ASGFIVSSNYMSWVRQAPGKGLE WVSVIYSGGSTFYTDSVKGRFTIS RDNSKNTLYLQMNSLRAEDTAVY YCVRDYGDFYFDWGQGTLVTV SS | 50 | EIVLTQSPGTLSLSPGERATLSCRA SQSVSSSYLAWYQQKPGQAPRLLI YGASSRATGIPDRFSGGGSETDFT LTISRLEPEDCAVYYCQQYGSSPR TFGQGTKVEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C102 | V-C002 | 51 | QVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDYGDYYFDYWGQGTLVTVSS | 52 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK |
| C103 | V-C003 | 53 | QVQLQQWGAGLLKPSETLSLTCAVSGGSLSGFYWTWIRQPPGKGLEWIGETNHFGSTGYKPSLKSRVTISVDMSRNQFSLKVTSVTAADTAVYYCARKPLLYSDFSPGAFDIWGQGTMVTVSS | 54 | EIVLTQSPGTLSLSPGERATLSCRASQTVTANYLAWYQQKPGQAPRLLIYGASKRATGIPDRFSGSGSGTDFTLSISRLEPEDFAVYYCQQYTTTPRTFGGGTKVEIK |
| C104 | V-C004 | 55 | QVQLQQWGAGLLKPSETLSLSCAVYGGSLSGYYWSWIRQPPGKGLEWIGEINHFGSTGYNPSLKSRVTISVDTSKSQFSVKLSSVTAADTAVYYCARKPLLYSNLSPGAFDIWGQGTMVTVSS | 56 | EIVLTQSPGTVSLSPGERATLSCWASQSVSASYLAWYQQKPGQAPRLLIYGASSRATGIPDRFSGSGSGTDFTLTISRLEPEDFAVYYCQQYGTTPRTFGGGTKVEIK |
| C105 | V-C005 | 57 | QVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGWELPYDYWGQGTLVTVSS | 58 | QSALTQPPSASGSPGQSVTISCTGTSSDVGGYKYVSWYQQHPGKAPKLMIYEVSKRPSGVPDRFSGSKSGNTASLTVSGLQAEDEADYYCSSYEGSNNFVVFGGGTKLTVL |
| C106 | V-C006 | 59 | QLQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS | 60 | SYELTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL |
| C107 | V-C007 | 61 | QVQLVQSGAEVKKPGASVRVSCKASGYTFTSYGFSWVRQAPGQGLEWMGWISAYNGNTNFAQKLQGRVTMTTDTSTSTAYMELRSLRSDDTAVYYCARGEAVAGTTGFFDYWGQGTLVTVSS | 62 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGFVVFGGGTKLTVL |
| C108 | V-C008 | 63 | QVQLQESGPGLVKPSGTLSLTCAVSGGSISSTNWWSWVRQPPGKGLEWIGEIYHTGSTNYNPSLKSRVTISVDKSKNQFSLKLSSVTAADTAVYYCVRDGGRPGDAFDIWGQGTMVTVSS | 64 | QSALTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL |
| C110 | V-C010 | 65 | QVQLQQSGAEVKKPGESLKISCKGSGYSFTSYWIGWVRQMPGKGLEWMGIIYPGDSDTRYSPSFQGQVTISADKSISTAYMQWSSLKASDTAMYYCARSFRDDPRIAVAGPADAFDIWGQGTMVTVSS | 66 | DIQMTQSPSTLSASVGDRVTITCRASQSISYWLAWYQQKPGKAPKLLIYQASSLESGVPSRFSGSESGTEFTLTISSLQPDDFATYYCQQYNSYPYTFGQGTKLEIK |
| C112 | V-C012 | 67 | QVQLVESGGGVVQPGRSLRLSCAASGFTFSSHAMHWVRQAPGKGLEWVAVISYDGSNKYYADSVKGRFTISRDNSKNTLYLQMNSLRAEDTAVYYCAREDYYDSSGSFDYWGQGTLVTVSS | 68 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL |
| C113 | V-C013 | 69 | QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS | 70 | DIQMTQSPSTLSASVGDRVTITCRASQSMSSWLAWYQQKPGNAPKLLIYKASSLESGVPSRFSGSGSGTEFTLTISSLQPDDFATYYCQQHNSSPLTFGGGTKVEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C114 | V-C014 | 71 | QVQLVESGGGLIQPGGSLKLSCV VSGFTVSKNYISWVRQAPGKGLE WVSVIFAGGSTPYADSVKGRFAIS RDNSNNTLFLQMNSLRVEDTAIYY CARGDGELFFDQWGQGTLVTVSS | 72 | QSVLTQPPSVSGAPGQRVTISCTG TSSNIGAGYDVHWYQQLPGRAPK VLISGNNIRPSEVPDRFSGSRSGT SASLAITSLQPEDEAQYYCQSYDS SLYAVFGGGTKLTVL |
| C115 | V-C015 | 73 | QVQLVESGGGLIKPGRSLRLSCTA SGFTFGDYAMTWFRQAPGKGLE WVGFIRSKAYGGTTGYAASVKYR FTISRDDSKSIAYLQMDSLKTEDT AVYYCTRWDGWSQHDYWGQGT LVTVSS | 74 | DIVMTQSPLSLSVTPGEPASISCRS SQSLLHSNGNNYFDWYLQKPGQS PQLLIYLGSNRASGVPDRFSGSGS GTDFTLKISRVEAEDVGVYYCMQV LQIPYTFGQGTKLEIK |
| C116 | V-C016 | 75 | QVQLVESGGGVVQPGRSLRLSCA ASGFTYSTYAMHWVRQAPGKGL EWVAFISYDGSNKYYADSVKGRF TISRDNSKNTLYLQMNSLRAEDTA VYYCARDFYHNWFDPWGQGTLV TVSS | 76 | NFMLTQPHSVSESPGKTVTISCTG SSGSIASNYVQWYQQRPGSAPTT VIYEDNQRPSGVPDRFSGSIDRSS NSASLTISGLKTEDEADYYCQSYD SGNHWVVFGGGTRLTVL |
| C117 | V-C017 | 77 | QVQLVESGGGVVQPGRSLRLSCA ASGFTFSTYAMHWVRQAPGEGL EWVAVISYDGSNTYYADSVKGRF TISRDNSKNTLYLQMNSLRAEDTA VYYCARDPIWFGELLSPPFVHFDY WGQGTLVTVSS | 78 | QSVLTQPPSVSAAPGQKVTISCSG SSSSNIGNNLVSWYQQLPGTAPKLLI YENNKRPSGIPDRFSGSKSGTSAT LGITGLQTGDEADYYCGAWDSSLS AGGVYVFGTGTKVTVL |
| C118 | V-C018 | 79 | QVQLVESGGGVVQPGRSLRLSCA ASGFTFSNYAMHWVRQAPGKGL EWVAVISDGSNKYYADSVKGRF TISRDNSKNTLYLQMNSLRAEDTA IYYCASGYTGYDYFVRGDYYGLD VWGQGTTVTVSS | 80 | QPVLTQSPSASASLGASVKLTCTL SSGHSSYAIAWHQQQPEKGPRYL MKLNTDGSHSKGDGIPDRFSGSS SGAERYLTISSLQSEDEADYYCQT WGTGILVFGGGTKLTVL |
| C119 | V-C019 | 81 | QVQLVQSGAEVKKPGASVKVSCK ASGYTFTSYYMHWVRQAPGQGL EWMGIINPSGGSTSYAQKLQGRV TMTRDTSTSTVYMELSSLRSEDT AVYYCARANHETTMDTYYYYYM DVWGKGTTVTVSS | 82 | QSALTQPASVSGSPGQSITISCTGT SSDVGGYKYVSWYQRHPGKAPKL MIYDVSNRPSGVSNRFSGSKSGN TASLTISGLQAEDEADYYCSSYTSS STSVVFGGGTQLTVL |
| C120 | V-C020 | 83 | EVQLVESGGGLIQPGGSLRLSCA ASGFTVSSNYMTWVRQAPGKGL EWVSLIYPGGSTYYADSVKGRFTI SRDNSKNTLYLQMNSLRAEDTAV YYCAREGMGMAAAGTWGQGTLV TVSS | 84 | AIRMTQSPSSLSASVGDTVTITCQA SQDISKYLNWYQQKPGKAPKLLIY DASNLETGVPSRFSGSGSGTDFTF TISSLQPEDIATYYCQQYDNLPQTF GGGTKVEIK |
| C121 | V-C021 | 85 | QVQLVQSGAEVKKPGASVKVSCK ASGYTFTGYYMHWVRQAPGQGL EWMGWISPVSGGTNYAQKFQGR VTMTRDTSISTAYMELSRLRSDDT AVYYCARAPLFPTGVLAGDYYYY GMDVWGQGTTVTVSS | 86 | QSALTQPASVSGSPGQSITISCTGT SSDVGSYNLVSWYQQHPGKAPKL MIYEGSKRPSGVSNRFSGSKSGN TASLTISGLQAEDEADYYCCSYAG SSTLVFGGGTKLTVL |
| C122 | V-C022 | 87 | EVQLVESGGGLIQPGGSLRLSCA ASGLTVSSNYMSWVRQAPGKGL EWVSVLYSGGSSFYADSVKGRFT ISRDNSKNTLYLQMNSLRAEDTAV YYCARESGDTTMAFDYWGQGTL VTVSS | 88 | DIQLTQSPSFLSASVGDRVTITCRA SQGISSYLAWYQQKPGKAPKLLIY AASTLQSGVPSRFSGSGSGTEFTL TISSLQPEDFATYYCQQLNSDSYT FGQGTKLEIK |
| C123 | V-C023 | 89 | EVQLVESGGGLIQPGGSLRLSCA ASGVTVSRNYMSWVRQAPGKGL EWVSVIYSGGSTYYADSVKGRFTI SRDNSKNTLYLQMNSLRAEDTAV YYCARDLSAAFDIWGQGTMVTVSS | 90 | DIQLTQSPSFLSASVGDRVTITCRA SQGISSYLAWYQQKPGKAPKLLIY AASTLQSGVPSRFSGSGSGTEFTL TISSLQPEDFATYYCQQLNSYPPA FGQGTRLEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C124 | V-C024 | 91 | EVQLVESGGGLVQPGGSLRLSCA ASGFTFSGYSMNWVRQAPGKGP EWVSYISRSSSTIYYADSVKGRFTI SRDNAKNSLYLQMNSLRDEDTAV YYCAREGARVGATYDTYYFDYW GQGTLVTVSS | 92 | EIVLTQSPATLSLSPGERATLSCRA SQSFSSYLAWYQQKPGQAPRLLIY DASNRATGIPARFSGSGSGTDFTL TISSLEPEDFAVYYCQQRNNWPPE WTFGQGTKVEIK |
| C125 | V-C025 | 93 | QVQLVQSGPEVKKPGTSVKVSCK ASGFTFTSSAVQWVRQARGQRL EWIGWIVVGSGNTNYAQKFQERV TITRDMSTSTAYMELSSLRSEDTA VYYCAAPYCSGGSCSDAFDIWGQ GTMVTVSS | 94 | EIVLTQSPGTLSLSPGERATLSCRA SQSVSSSYLAWYQQKPGQAPRLLI YGASSRATGIPDRFSGSGSGTDFT LTISRLEPEDFAVYYCQQYGSSPW TFGQGTKVEIK |
| C126 | V-C026 | 95 | QVQLQESGPGLVKPSETLSLSCA VSGGSIGSYFWSWIRQPPGKGLE WIGYLHYSGSTNYNPSLKSRVTIS VDTSKNQFSLKLSSVTAADTAVYY CARLQWLRGAFDIWGQGTMVTV SS | 96 | NFMLTQPHSVSESPGKTVTISCTG SSGSIASNYVQWYQQRPGSAPTT VINEDNQRPSGVPDRFSGSIDSSS NSASLTISGLKTEDEADYYCQSYD SSNLVFGGGTKLTVL |
| C127 | V-C027 | 97 | QVQLVQSGAEVKKPGASVKVSCK ASGYTFTGYYMHWVRQAPGQGL EWMGWINPNSGGTNYAQKFQGR VTMTRDTSISTAYMELSRLRSDDT AVYYCATAHPRRIQGVFFLGPGV WGQGTTVTVSS | 98 | QSVLTQPPSASGTPGQRVTISCSG SSSNIGSNTVNWYQQLPGTAPKLL IYSNNQRPSGVPDRFSGSKSGTSA SLAISGLQSEDEADYYCAAWDDSL NGVVFGGGTKLTVL |
| C128 | V-C028 | 99 | EVQLLESGGGLVQPGGSLRLSCA ASGFTFSTYAMSWVRQAPGKGLE WVSTITGSGRDTYYADSVKGRFTI SRDNSKNTLFLQLNSLRAEDAAVY SCANHPLASGDDYYHYYMDVWG KGTTVTVSS | 100 | EIVLTQSPGTLSLSPGERATLSCRA SQSVNSRQLAWYQQKPGQAPRLL IYGASSRATGIPERFSGSGSGTDF TLTISRLESEDFAVYHCQQYGSSR ALTFGGGTKVEIK |
| C129 | V-C029 | 101 | QVQLVESGGGVVQPGRSLRLSCA ASGFTFSSYGMNWVRQAPGKGL EWVAVISYDGSNTYYTDSVKGRF TISRDNSKNTLYLQMNSLRVDDTA TYYCAKGPRFGWSYRGGSGFDI WGQGTMVTVSS | 102 | DIQMTQSPSSLSASVGDRVTITCQ ASQDISNYLNWYQQKPGKAPKLLI YDASNLETGVPSRFSGSESGTDFT FTISSLQPEDIATYYCQQYDNLPITF GQGTRLEIK |
| C130 | V-C030 | 103 | QVQLVQSGAEVKKPGASVKVSCK ASGYTFTNYYMHWVRQAPGQGL EWMGIINPSGGSTGYAQKFQGRV TMTRDTSTSTVYMELSSLRSEDT AVYYCARSRPTPDWYFDLWGRG TLVTVSS | 104 | SYELTQPPSVSVAPGKTARITCGG NNIGSKSVHWYQQKPGQAPVLVIY YDSDRPSGIPERFSGSNSGNTATL TISRVEAGDEADYYCQVWDSSSD HPGVVFGGGTKLTVL |
| C131 | V-C031 | 105 | QVQLVQSGSEVKKPGSSVKVSCK ASGGTFSSYAFSWVRQAPGQGL EWMGRIIPILALANYAQKFQGRVTI TADKSTSTAYMELSSLRSEDTAVY YCARVNQAVTTPFSMDVWGQGT TVTVSS | 106 | EIVMTQSPATLSVSPGERATLSCR ASQSVSSNLAWYQQKPGQAPRLLI YGASTRATGIPARFSGSGSGTEFT LTISSLQSEDFAVYYCQQYNNWPI TFGQGTRLEIK |
| C132 | V-C032 | 107 | QVQLQESGPGLVKPSGTLSLTCA VSGGSISSNNWWSCVRQPPGKG LEWIGEIYHSGSTNYNPSLKSRVTI SVDKSKNQFSLKLSSVTAADTAVY YCARGGDTAMGPEYFDYWGQGT LVTVSS | 108 | QSALTQPASVSGSPGQSITISCTGT SSDVGGYNYVSWYQQHPGKAPKL MIYDVSNRPSGVSNRFSGSKSGN TASLTISGLQAEDEADYYCSSYTSS STLLFGGGTKLTVL |
| C133 | V-C033 | 109 | QVQLVESGGGVVQPGRSLRLSCA ASGFTFSSYAMHWVRQAPGKGL EWVAVILYDGSNKYYADSVKGRF TISRDNSKNTLYLQMNSLRAEDTA VYYCARDSDVDTSMVTWFDYWG QGTLVTVSS | 110 | DIQMTQSPSSLSASVGDRVTITCR ASQSISSYLNWYQQKPGKAPKLLI YAASSLQSGVPSRFSGSGSGTDF TLTISSLQPEDFATYYCQQSYSTPP WTFGQGTKVEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C134 | V-C034 | 111 | EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS | 112 | SYELTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL |
| C135 | V-C035 | 113 | QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSS | 114 | DIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIK |
| C138 | V-C038 | 115 | EVQLVESGGGLVQPGGSLRLSCAASGFTFSTYWMSWVRQPPGKGLEWVANIKQDGSEKYYVDSVKGRFTISRDNAKNSLYLQMNSLRADDTAVYYCAGGTWLRSSFDYWGQGTLVTVSS | 116 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL |
| C139 | V-C039 | 117 | EVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS | 118 | DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK |
| C140 | V-C040 | 119 | EVQLVESGGGLVQPGGSLRLSCAASGVTVSSNYMSWVRQAPGKGLEWVSLIYSGGSTFYADSVKGRFTISRDNSENTLYLQMNTLRAEDTAVYYCARDLYYYGMDVWGQGTTVTVSS | 120 | DIQLTQSPSFLSASVGDRVTITCRASQGISSYLAWYQQKPGKAPKLLIYAASTLQSGVPSRFSGSGSGTEFTLTISSLQPEDFATYYCQQLNSYSYTFGQGTKLEIK |
| C141 | V-C041 | 121 | EVQLVESGGGWQPGRSLRLSCAASGFTFSSYAMFWVRQAPGKGLEWVAVISYDGSNKYYADSVKGRFTISRDNSKNTLYLQMNSLRAEDTAVYYCARADLGYCTNGVCYVDYWGQGTLVTVSS | 122 | NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL |
| C143 | V-C043 | 123 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 124 | QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL |
| C144 | V-C044 | 125 | EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS | 126 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL |
| C145 | V-C045 | 127 | EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 128 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL |
| C146 | V-C046 | 129 | EVQLVESGGGLVKPGGSLRLSCAASGLTFTAYRMNWVRQAPGKGLEWLSSISNTNGDIYYADSVKGRFTISRDNAKNSLYLQMNSLRADDTAVYYCARDVASNYAYFDLWGQGTLVTVSS | 130 | QSALTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C147 | V-C047 | 131 | EVQLVQSGAEVKKPGESLKISCK GSGYRFTNYWIGWVRQMPGKGL EWMGIIYPGDSDTRYSPSFQGQV TISADKSITTAYLQWSSLKASDTA MYYCARLSDRWYSPFDPWGQGT LVTVSS | 132 | QAVVTQEPSLTVSPGGTVTLTCGS STGAVTSGHYPYWFQQKSGQAPR TLIYETSIKHSWTPARFSGSLLGGK AALTLSGAQPEDEADYYCLLSYSG ARPVFGGGTKLTVL |
| C148 | V-C048 | 133 | EVQLVESGGGLVQPGGSQRLSC AASGFTVSSNYMSWIRQAPGKGL EWVSVIYSGGSAYYVDSVKGRFTI SRDNSKNTLYLQMNSLRPEDTAV YYCARIANYMDVWGKGTTVTSS | 134 | EIVMTQSPATLSVSPGERATLSCR ASQSVSSHLAWYQQKPGQAPRLLI YGASTRATGIPTRFSGSGSGTEFT LTISSLQSEDFAVYYCQQYNNWPP LTFGGGTKVEIK |
| C149 | V-C049 | 135 | QVQLVESGGGVVQPGRSLRLSCA ASGFTFSTYGMHWVRQAPGKGL EWVAVISYDGSNKYFADSVKGRF TISRDNSKNTLYLQMNSLRPEDTA VYYCAKVGMEYSSGWYGEEIDF WGQGTLVTVSS | 136 | DIQMTQSPSSLSASVGDRVTITCR ASQSISSYLNWYQQKPGKVPKLLI YAASSLQSGVPSRFSGSGSGTDF TLTISSLQPEDFATYYCQQSYRTPL TFGGGTKVEIK |
| C150 | V-C050 | 137 | EVQLVESGGGLVQPGGSLRLSCV ASGFTFSSYWMHWVRQVPGKGP VWVSHINSEGSSTNYADSVRGRF TISRDNAKDTLYLQMNNLRAEDTA VYYCARPTAVAAAGNYFYYYGMD VWGQGTTVTVSS | 138 | QSALTQPASVSGSPGQSITISCTGT SSDVGYYNFVSWYQQHPGKAPKL MIYEVSNRPSGVSNRFSGSKSGNT ASLIISGLQAEDEADYYCSSYRSSS TLVFGGGTKLTVL |
| C151 | V-C051 | 139 | EVQLVESGGGLVKPGGSLRLSCA ASGFTFSSYNMNWVRQAPGKGL EWVSCISSSSSYIYYADSVKGRFTI SRDNAKNSLYLQMNSLRAEDTAV YYCARERGYDGGKTPPFLGGQG TLVTVSS | 140 | NFMLTQPHSVSESPGKTVTISCTG SSGSIASNYVQWYQQRPGSAPTT VIYEDNQRPSGVPDRFSGSIDSSS NSASLTISGLKTEDEADYYCQSYD SSNYWVFGGGTKLTVL |
| C152 | V-C052 | 141 | QVQLVQSGAEVKKPGASVKVSCK ASGYTFTSYGISWVRQAPGQGLE WMGWISAYNGNTNYAQKLQGRV TMTTDTSTSTAYMELRSLRSDDT AVFYCARDRGGHDFWSGYGFYY YYGMDVWGQGTTVTVSS | 142 | DIQMTQSPSSLSASVGDRVTITCR ASQGISNYLAWYQQRPGKVPKLLI FAASTLQSGVPSRFSGSGSGTDFT LTISSLQPEDVATYYCQKYNSAPR TFGQGTKVEIK |
| C153 | V-C053 | 143 | EVQLVESGGGLIQPGGSLRLSCA ASGFTVSSNYMSVWRQAPGKGL EWVSVIYSGYSTYYVDSVKGRFTI SRDNSKNTLYLQMNSLRAEDTAV YYCARVGGAHSGYDGSFDYWGQ GTLVTVSS | 144 | QSALTQPASVSGSPGQSITISCTGT SSDVGSYNLVSWYQQHPGKAPKL MIYEGSKRPSGVSNRFSGSKSGN TASLTISGLQAEDEADYYCCSYAG SSTWVFGGGTKLTVL |
| C154 | V-C054 | 145 | QVQLVESGGGVVQPGRSLRLSCA ASGFTFSRYGMHWVRQAPGKGL EWVAVMSYDGSSKYYADSVKGR FTISRDNSKNTLCLQMNSLRAEDT AVYYCAKQAGPYCSGGSCYSAPF DYWGQGTLVTVSS | 146 | DIQMTQSPSSLSASVGDRVTITCQ ASQGISNYLNWYQQKPGKAPKLLI YDASNLETGVPSRFSGSGSGTDFT FTISSLQPEDIATYYCQQYDNLPITF GQGTRLEIK |
| C155 | V-C055 | 147 | EVQLVESGGGLIQPGGSLRLSCA ASGFIVSSNYMSWVRQAPGKGLE WVSVIYSGGSTFYADSVKGRFTIS RDNSKNTLYLQMNSLRAEDTAVY YCARDFGEFYFDYWGQGTLVTVSS | 148 | EIVMTQSPATLSVSPGERATLSCR ASQSVSSNLAWYQQKPGQAPRLLI YGASTRATAIPARFSGSGSGTEFT LTISSLQSEDFAVYYCQQYNNWPR TFGQGTKVEIK |
| C156 | V-C056 | 149 | QVQLVESGGGVVQPGRSLRLSCA ASGFTFSNYGMHWVRQAPGKGL EWVAVISYDGNNKYYADSVKGRF TISRDNSKNTLYLQMNSLRAEDTA VYYCAKDPFPLAVAGTGYFDYWG QGTLVTVSS | 150 | SYELTQPPSVSVAPGQTARISCGG NNIGSKNVHWYQKPGQAPVLVV YDDSDRPSGIPERFSGSNSGNTAT LTISRVEAGDEADYYCQVWDSSSD PWVFGGGTKLTVL |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C160 | V-C060 | 151 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVPASYGDDDYYYYGMDVWGQGTTVTVSS | 152 | SYELTQPPSVSVSPGQTARITCSGDALPKQYAYWYQQKPGQAPVLVIYKDSERPSGIPERFSGSSSGTTVTLTISGVQAEDEADYYCQSADSSGTLVWFGGGTKLTVL |
| C161 | V-C061 | 153 | QVQLQQWGAGLLKPSETLSLTCAVSGGSLSGFYWTWIRQPPGKGLEWIGETNHFGSTDYKPSLKSRVTISVDMSRNQFSLIMTSVTAADTAVYYCARKTLLFSDFSPGAFDIWGQGTMVTVSS | 154 | EIVLTQSPGTLSLSPGERATLSCRASQTLTANYLAWYQQKPGQAPRLLIYGASKRATGIPDRFSGSGSGTDFTLSISRLEPEDFAVYYCQQYGTTPRTFGGGTKVEI |
| C162 | V-C062 | 155 | QVQLQQWGAGLLKPSETLSLTCAVSGGSLSGFYWTWIRQPPGKGLEWIGETNHFGSTDYKASLKSRVTISVGMSRNQFSLKVTSLTAADTAVYYCARKPLLYSDFSPGAFDVWGQGTMVTVSS | 156 | EIVLTQSPGTLSLSPGERATLSCRASQTLTANYLAWYQQKPGQAPRLLIYGASKRAAGIPDRFSGSGSGTDFTLSITRLEPEDFAVYYCQQYHTTPRTFGGGTKVEI |
| C163 | V-C063 | 157 | QVQLQQWGAGLLKPSETLSLTCAVSGGSLSGFYWTWIRQPPGKGLEWIGETNHFGSTDYKPSLKSRVTISVDMSRNQFSLKVTSVTAADTAVYYCARKPLLHSDLSPGAFDIWGQGTMVTVSS | 158 | EIVLTQSPGTLSLSPGERATLSCRASQTVSANYLAWYQQKAGQAPRLLIYGASKRATGIPDRFSGSGSGTDFTLSISRLEPEDFAVYYCQQYVTTPRTFGGGTKVEI |
| C164 | V-C064 | 159 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 160 | QSALTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL |
| C165 | V-C065 | 161 | QVQLVQSGAEVKKPGSSVKVSCKASGGTFSSYAINWVRQAPGQGLEWMGRHPIVGIANYAQKFQGRVTITADKSSSTAYMELSSLRSEDTAVYYCARDLLDPQLDDAFDIWGQGTMVTVSS | 162 | EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPWTFGQGTKVEIK |
| C201 | M-C001 | 163 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVKGVEYSSSSNFDYWGQGTLVTVSS | 164 | IRMTQSPSSVSASVGDRVTITCRASQGISSWLAWYQQKPGKAPKLLIYVESSLQSGVPSRFSGSGSGTDFTLTISSLQPEDFATYYCQQANSFPLTFGGGTKVEIK |
| C202 | M-C002 | 165 | EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTLGRGGDYWGQGTLVTVSS | 166 | DIQLTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK |
| C204 | M-C004 | 167 | EVQLLESGGGLEQPGGSLRLSCAASGFTFSTYAMSWVRQAPGKGLEWVSAISGSGAGTFYADSVKGRFTISRDNSKNTLYLQMNSLRAEDTAVYYCARESDCGSTSCYQVGWFDPWGQGTLVTVSS | 168 | DIQLTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK |
| C205 | M-C005 | 169 | QVQLVQSGAEVKKPGASVKVSCKASGHTFTSYYMHWVRQAPGQGLEWMGIINPSGGSTSYAQKFQGRVTMTRDTSTSTVYMELSSLRSEDTAVYYCARGPERGIVGATDYFDYWGQGTLVTVSS | 170 | EIVLTQSPGTLSLSPGERATLSCRASQSVSSSYLAWYQQKPGQAPRLLIYGASSRATGIPDRFSGSGSGTDFTLTISRLEPEDFAVYYCQQYVSSPWTFGQGTKVEIK |

TABLE 4-continued

Representative amino acid sequences of cloned recombinant antibodies

| Antibody ID | Old antibody ID | SEQ ID NO | IGH VDJ (aa) | SEQ ID NO | IGL VJ (aa) |
|---|---|---|---|---|---|
| C207 | M-C007 | 171 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS | 172 | EIVLTQSPATLSLSPGERATLSCRASQSVSSYLAWYQQKPGQAPRLLIYDASNRATGIPARFSGSGSGTDFTLTISSLEPEDFAVYYCQQRSNWPRGFGQGTKVEIK |
| C208 | M-C008 | 173 | EVQLVQSGAEVKKPGESLKISCKGSGYSFTSYWIGWVRQMPGKGLEWMGIIYPGDSDTRYSPSFQGQVTISADKSISTAYLKWSSLKASDSAMYYCARGPNLQNWFDPWGQGTLVTVSS | 174 | EIVLTQSPGTLSLSPGERATLSCRASQSVSGSYLAWYQQRPGQAPRLLIYGASSRATGIPDRFSGSGSGTDFTLTISRLEPEDFAVYYCQQYGSSLTFGGGTKVEIK |
| C209 | M-C009 | 175 | QVQLVQSGAEVKKSGASVKVSCKASGYTFTSYDINWVRQATGQGLEWMGWMNPNSGNTGYAQKFQGRVTMTRNTSISTAYMXLSSLXSXXTAVYYCAXGFSLTWYFDLWGRGXLVTXSS | 176 | SYELTQPPSVSVAPGKTARITCGGNNIGSKSVHWYQQKPGHAPVLVVYDDSDRPSGIPERFSGSNSGNTATLTISRVEAGDEADYYCQVWDSTGGHPDVVFGGGTKLTVL |
| C210 | M-C010 | 177 | EVQLVESGGGLIQPGGSLRLSCAASGFTVSSNYMSWVRQAPGKGLEWVSVIYSGGSTFYADSVKGRFTFSRDNSKNTLYLQMNSLRAEDTAVYYCARDLMAYGMDVWGQGTTVTVSS | 178 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPQGTFGGGTKVEIK |
| C211 | M-C011 | 179 | EVQLVESGGGLVQPGGSLRLSCAASEFTVSSNYMSWVRQAPGKGLEWVSVIYSGGSTFYADSVKGRFTISRDNSKNTLYLQMNSLRPEDTAVYYCARDYGDFYFDFWGQGTLVTVSS | 180 | EIVMTQSPATLSVSPGERATLSCRASQSVSSNLAWYQQKPGQGPRLLIYGASTRATGIPARFSGSGSGTEFTLTISSLQSEDFAVYYCQQYNNWPRTFGQGTKVEIK |
| C212 | M-C012 | 181 | QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCARERYFDLGGMDVWGQGTTVTVSS | 182 | LTQPASVSGSPGQSITISCTGTSSDVGSYNLVSWYQQHPGKAPKLMIYEDSKRPSGVSNRFSGSKSGNTASLTISGLQAEDEADYYCCSYAGSSTRLFGGGTKLTVL |
| C214 | M-C014 | 183 | QVQLVESGGGVVQPGRSLRLSCAASGFTFSSYGMHWVRQAPGKGLEWVAAIWYDGSNKHYADSVKGRFTISRDNSKNTLYLQMNSLRAEDTAVYYCARDVGRVTTWFDPWGQGTLVTVSS | 184 | DIQLTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK |
| C215 | M-C015 | 185 | EVQLLESGGGLVQPGGSLRLSCAASGFTFSSYAMSWVRQAPGKGLEWVSAITDSGDGTFYADSVKGRFTISRDNSKNTLYLQMNSLRAEDTAVYYCASEEDYSNYVGWFDPWGQGTLVTVSS | 186 | DIQLTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK |
| C216 | M-C016 | 187 | EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARDRGSSGWYGWYFDLWGRGTLVTVSS | 188 | DIQLTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIK |

TABLE 5

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| C002 | A-C002 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTATCTATGGCATGCACT GGGTCCGCCAGGCTCCAGGCAAGGGG CTGGAGTGGGTGGCAGTTATATCATAT GATGGAAGTAATAAATACTATGCAGAC TCCGTGAAGGGCCGATTCACCATCTCC AGAGACAATTCCAAGAACACGCTGTAT CTGCAAATGAACAGCCTGAGAGCTGAG GACACGGCCGTGTATTACTGTGCGAAA GAGGGGAGACCATCTGATATTGTAGTG GTGGTGGCCTTTGACTACTGGGGCCA GGGAACCCTGGTCACCGTCTCCTCAG | 189 | GACATCCAGTTGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCTCGGACGTT CGGCCAAGGGACCAAGGTGGAAATCAAAC | 190 |
| C003 | A-C003 | GAGGTGCAGCTGGTGGAGTCTGGAGG AGGCTTGATCCAGCCTGGGGGGTCCC TGAGACTCTCCTGTGCAGCCTCTGGGT TCACCGTCAGTAGCAACTACATGAGCT GGGTCCGCCAGGCTCCAGGCAAGGGG CTGGAGTGGGTCTCAGTTATTTATAGC GGTGGTAGCACATACTACGCAGACTCC GTGAAGGGCCGATTCACCATCTCCAGA GACAATTCCAAGAACACGCTGTATCTT CAAATGAACAGCCTGAGAGCCGGGGA CACGGCCGTGTATTACTGTGCGAGGG ATTACGGTGACTTCTACTTTGACTACTG GGGCCAGGGAACCCTGGTCACCGTCT CCTCAG | 191 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCACCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGGTAGCTCACCTAGG ACTTTTGGCCAGGGGACCAAGCTGGAGAT CAAAC | 192 |
| C004 | A-C004 | CAGGTGCAGCTGGTGCAGTCTGGGGC TGAGGTGAAGAAGCCTGGGGCCTCAG TGAAGGTCTCCTGCAAGGCTTCTGGAT ACACCTTCACCGGCTACTATATGCACT GGGTGCGACAGGCCCCTGGACAAGGG CTTGAGTGGATGGGATGGATCAACCTC ATCAGTGGTGGCACAAACTATGCACAG AAGTTTCAGGGCAGGGTCACCATGACC AGGGACACGTCCATCAGCACAGCCTAC ATGGAGCTGAGCAGGCTGAGATCTGA CGACACGGCCGTGTATTACTGTGCGAG CCCAGCATCACGTGGATATAGTGGCTA CGATCATGGGTACTACTACTACATGGA CGTCTGGGGCAAAGGGACCACGGTCA CCGTCTCCTCA | 193 | GCCATCCGGATGACCCAGTCTCCATCCTC CCTGTCTGCATCTGTAGGAGACAGAGTCA CCATCACTTGCCAGGCGAGTCAGGACATT AGCAACTATTTAAATTGGTATCAGCAGAAA CCAGGGAAAGCCCCTAAGCTCCTGATCTA CGATGCATCCAATTTGGAAACAGGGGTCC CATCAAGGTTCAGTGGAAGTGGATCTGGG ACAGATTTTACTTTCACCATCAGCAGCCTG CAGCCTGAAGATATTGCAACATATTACTGT CAACAGTATGATAATCTCCCTATCACCTTC GGCCAAGGGACACGACTGGAGATTAAAC | 194 |
| C005 | A-C005 | CAGGTGCAGCTGGTGCAGTCTGGGCC TGAGGTGAAGAAGCCTGGGACCTCAG TGAAGGTCTCCTGCAAGGCTTCTGGAT TCACCTTTACTAGCTCTGCTGTGCAGT GGGTGCGACAGGCTCGTGGACAACGC CTTGAGTGGATAGGATGGATCGTCGTT GGCAGTGGTAACACAAACTACGCACAG AAGTTCCAGGAAAGAGTCACCATTACC AGGGACATGTCCACAAGCACAGCCTAC ATGGAGCTGAGCAGCCTGAGATCCGA GGACACGGCCGTGTATTACTGTGCGG CTCCCCATTGTAGCGGTGGTAGCTGCC TTGATGCTTTTGATATCTGGGGCCAAG GGACAATGGTCACCGTCTCTTCAG | 195 | GAAATTGTGTTGACGCAGTCTCCAGGCAC CCTGTCTTTGTCTCCAGGGGAAAGAGCCA CCCTCTCCTGCAGGGCCAGTCAGAGTGTT AGAAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGGTAGCTCACCGTGG ACGTTCGGCCAAGGGACCAAGGTGGAAAT CAAAC | 196 |
| C006 | A-C006 | CAGGTGCAGCTGGTGGAGTCTGGGGG AGGCTTGGTCAAGCCTGGAGGGTCCC TGAGACTCTCCTGTGCAGCCTCTGGAT TCATCTTCAGTGACTACTGCATGAGCT GGATCCGCCGGGCTCCAGGGAAGGGG CTGGAATGGCTTTCATATATTAGTAATA GTGGTACCACCAGATACTACGCAGACT CTGTGAAGGGCCGATTCACCATCTCCA | 197 | CAGTCTGTGCTGACTCAGCCACCCTCAGC GTCTGGGACCCCCGGACAGAGGGTCACC GTCTCTTGTTCTGGAAGCAGCTCCAACATC GGAAGCAATACTGTAAACTGGTACCAGCA GCTCCCAGGAACGGCCCCCAAACTCCTCA TCTATAGTAATAATCAGCGGCCCTCAGGG GTCCCTGACCGATTCTCTGGCTCCAAGTC TGGCACCTCAGCCTCCCTGGCCATCAGTG | 198 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GGGACAACGGCAGGAACTCACTGTATC TGCAAATGGACAGCCTGAGCGCCGAA GACACGGCCGTTTATTACTGTGCGAGA AGGGGGGACGGTAGCAGCTCGATCTA CTACTACAACTACATGGACGTCTGGGG CAAAGGGACCACGGTCACCGTCTCCTCA | | GGCTCCAGTCTGAGGATGAGGCTGATTAT TTCTGTGCAGCATGGGATGACAGCCTGAA TGGTCCGGTATTCGGCGGAGGGACCAAG CTGACCGTCCTAG | |
| C008 | A-C008 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGGCATGCACT GGGTCCGCCAGGCTCCAGGCAAGGGG CTGGAGTGGGTGACAGTTATTTCATAT GATGGAAGGAATAAATACTATGCAGAC TCCGTGAAGGGCCGATTCACCATCTCC AGAGACAACTCCAAGAACACGCTGTAT CTGCAAATGAACAGCCTGAGAGCTGAG GACACGGCTGTGTATTACTGTGCGAGA GAATTCGGTGACCCCGAGTGGTACTTT GACTACTGGGGCCAGGGAACCCTGGT CACCGTCTCCTCAG | 199 | GACATCCAGATGACCCAGTCTCCTTCCAC CCTGTCTGCATCTGTAGGAGACAGAGTCA CCATCACTTGCCGGGCCAATCAGAGTATT AGTAGCTGGTTGGCCTGGTATCAGCAGAA ACCAGGGAAAGCCCCTAAGCTCCTGATCT ATAAGGCGTCTAGTTTAGAAAGTGGGGTC CCATCAAGGTTCAGCGGCAGTGGATCTGG GACAGATTCACTCTCACCATCAGCAGCC TGCAGCCTGATGATTTTGCAACTTATTACT GCCAACAGTATAATAGTTATTGGACGTTCG GCCAAGGGACCAAGGTGGAAATCAAAC | 200 |
| C009 | A-C009 | CAGGTGCAGCTGGTGCAGTCTGGGGC TGAGGTGAAGAAGCCTGGGGCCTCAG TGAAGGTCTCCTGCATGGCTTCTGGAT ACACCTTCACCGGCTACTATATGCACT GGGTGCGACAGGCCCCTGGACAAGGG CTTGAGTGGATGGGATGGATCAACCCT AACAGTGGTGGCACAAACTATGCACAG AAGTTTCAGGGCAGGGTCACCATGACC AGGGACACGTCCATCAGCACAGCCTAC ATGGAGCTGAGCAGGCTGAGATCTGA CGACACGGCCGTGTATTACTGTGCGAG AGACTCCCCATTTAGTGCTTTAGGGGC CTCCAATGACTACTGGGGCCAGGGAA CCCTGGTCACCGTCTCCTCAG | 201 | CAGTCTGCCCCTGACTCAGCCTCCCTCCGC GTCCGGGTCTCCTGGACAGTCAGTCACCA TCTCCTGCACTGGAACCAGCAGTGACGTT GGTGGTTATAACTATGTCTCCTGGTACCAA CAGCACCCAGGCAAAGCCCCCAAACTCAT GATTTATGAGGTCAGTAAGCGGCCCTCAG GGGTCCCTGATCGCTTCTCTGGCTCCAAG TCTGGCAACACGGCCTCCCTGACCGTCTC TGGGCTCCAGGCTGAGGATGAGGCTGAG TATTACTGCAGCTCAGATGCAGGCAGCAA CAATGTGGTATTCGGCGGAGGGACCAAGC TGACCGTCCTAG | 202 |
| C010 | A-C010 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGCTATGCACT GGGTCCGCCAGGCTCCAGCCAAGGGG CTGGAGTGGGTGGCAGTTATATTATAT GATGGAAGCGGTAAATACTACGCAGAC TCCGTGAAGGGCCGATTCACCATCTCC AGAGACAATTCCAAGAACACGTTGTAT CTGCAAATGAACAGCCTGAGAGCTGAG GACACGGCTGTGTATTACTGTGCGAGA GACGGGATCGTGGATACAGCTCTGGTT ACGTGGTTTGACTACTGGGGCCAGGG AACCCTGGTCACCGTCTCCTCAG | 203 | GACATCCAGTTGACCCAGTCTCCATCCTC CCTGTCTGCATCTGTAGGAGACAGAGTCA CCATCACTTGCCGGGCAAGTCAGAGCATT AGCACCTATTTAAATTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCTCCGTGGAC GTTCGGCCAAGGGACCAAGGTGGAGATCA AAC | 204 |
| C013 | A-C013 | CAGGTGCAGCTGGTGCAGTCTGGGGC TGAGGTGAAGAAGCCTGGGTCCTCGG TGAAGGTCTCCTGCAAGGCTTCTGGAG GCACCTTCAGCAGCTATGCTATCAGCT GGGTGCGACAGGCCCCTGGACAAGGG CTTGAGTGGATGGGAGGGATCATCCCT ATCTTTGGTACAGCAAACTACGCACAG AAGTTCCAGGGCAGAGTCACGATTACC GCGGACGAATCCACGAGCACAGCCTA CATGGAGCTGAGCAGCCTGAGATCTGA GGACACGGCCGTGTATTACTGTGCGA GAGGGAATCGACTACTTTATTGTAGTA GTACCAGCTGCTATCTAGATGCGGTTA GGCAGGGGTACTACTACTACTACTACA TGGACGTCTGGGGCAAAGGGACCACG GTCACCGTCTCCTCA | 205 | GAAATTGTGTTGACACAGTCTCCAGCCAC CCTGTCTTTGTCTCCAGGGGAAAGAGCCA CCCTCTCCTGCAGGGCCAGTCAGAGTGTT AGCAGCTACTTAGCCTGGTACCAACAGAA ACCTGGCCAGGCTCCCAGGCTCCTCATCT ATGATGCATCCAACAGGGCCACTGGCATC CCAGCCAGGTTCAGTGGCAGTGGGTCTG GGACAGACTTCACTCTCACCATCAGCAGC CTAGAGCCTGAAGATTTTGCAGTTTATTAC TGTCAGCAGCGTAGCAACTGGCCCCTCAC TTTCGGCGGAGGGACCAAGGTGGAGATCA AAC | 206 |
| C016 | A-C016 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGATATGGCATGCACT GGGTCCGCCAGGCTCCAGGCAAGGGG | 207 | GCCATCCGGATGACCCAGTCTCCATCCTC CCTGTCTGCATCTGTAGGAGACAGAGTCA CCATCACTTGCCAGGCGAGTCAGGACATT AGCAACTATTTAAATTGGTATCAGCAGAAA CCAGGGAAAGCCCCTAAGCTCCTGATCTA | 208 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | CTGGAGTGGGTGGCAGTTATATCATAT GATGGAAGTAATAAATACTATGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAAA GTGACCGCCCCTTATTGTAGTGGTGGT AGCTGCTACGGAGGTAACTTTGACTAC TGGGGCCAGGGAACCCTGGTCACCGT CTCCTCAG | | CGATGCATCCAATTTGGAAACAGGGGTCC CATCAAGGTTCAGCGGAAGTGGATCTGGG ACAGATTTTACTTTCACCATCAACAGCCTG CAGCCTGAAGATATTGCAACATATTACTGT CAACAGTATGATAATCTCCCTCCTACTTTC GGCGGAGGGACCAAGGTGGAGATCAAAC | |
| C017 | A-C017 | GAAGTGCAGCTGGTGGAGTCTGGGGG AGGCTTGGTACAGCCTGGCAGGTCCC TGAGACTCTCCTGTGCAGCCTCTGGAT TCACCTTTGATGATTATGCCATGCACTG GGTCCGGCAAGCTCCAGGGAAGGGCC TGGAGTGGGTCTCAGGTATTAGTTGGA ATAGTGGTACCATAGGCTATGCGGACT CTGTGAAGGGCCGATTCACCATCTCCA GAGACAACGCCAAGAACTCCCTGTATC TGCAAATGAACAGTCTGAGAGCTGAGG ACACGGCCTTTTATTACTGTGCAAAAG CGGGCGTAAGGGGTATAGCAGCAGCT GGTCCCGACCTCAACTTCGACCACTGG GGCCAGGGAACCCTGGTCACCGTCTC CTCAG | 209 | GAAATTGTGTTGACACAGTCTCCAGCCAC CCTGTCTTTGTCTCCAGGGGAAAGAGCCA CCCTCTCCTGCAGGGCCAGTCAGAGTGTT AGCAGCTACTTAGCCTGGTACCAACAGAA ACCTGGCCAGGCTCCCAGGCTCCTCATCT ATGATGCATCCAACAGGGCCACTGGCATC CCAGCCAGGTTCAGTGGCAGTGGGTCTG GGACAGACTTCACTCTCACCATCAGCAGC CTAGAGCCTGAAGATTTTGCAGTTTATTAC TGTCAGCAGCGTATCACCTTCGGCCAAGG GACACGACTGGAGATTAAAC | 210 |
| C018 | A-C018 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAACTATGCTATACACTG GGTCCGCCAGGCTCCAGGCAAGGGGC TGGAGTGGGTGGCAGTTATATCATATG ATGGAAGCAATAAATACTACGCAGACT CCGTGAAGGGCCGATTCACCATCTCCA GAGACAATTCCAAGAACACGCTGTATC TGCAAATGAACAGCCTGAGAGCTGAGG ACACGGCTGTGTATTACTGTGCGAGAG ATTTTGACGATAGTCGTTCTGGGCGT TTGACTACTGGGGCCAGGGAACCCTG GTCACCGTCTCCTCAG | 211 | GACATCCAGTTGACCCAGTCTCCATCCTC CCTGTCTGCGTCTGTAGGAGACAGAGTCA CCATCACTTGCCGGGCAAGTCAGAGCATT CGCAGCTATTTAAATTGGTATCAACAGAAA CCAGGGAAAGCCCCTAAGCTCCTGATCTA TGCTGCATCCAGTTTGCAAAGTGGGGTCC CTTCAAGGTTCAGTGGCAGTGGATCTGGG ACAGATTTCACTCTCACCATCAGCAGTCTG CAACCTGATGATTTTGCAACTTACTACTGT CAACAGAGTTACAGTACCCCTCCGGCCAC TTTTGGCCAGGGGACCAAGCTGGAGATCA AAC | 212 |
| C019 | A-C019 | CAGGTGCAGCTGGTGCAGTCTGGGGC TGAGGTGAAGAAGCCTGGGGCCTCAG TGAAGGTTTCCTGCAAGGCATCTGGAT ACACCTTCACCAGTTACTATATGCACTG GGTGCGACAGGCCCCTGGACAAGGGC TTGAGTGGATGGGAATAATCAACCCTA GTGGTGGTAGCACAAGCTACGCACAG AAGTTCCAGGGCAGAGTCACCATGACC AGGGACACGTCCACGAGCACAGTCTA CATGGAGCTGAGCAGCCTGAGATCTGA GGACACGGCCGTGTATTACTGTGCTAG AGTGCCCCGTGAGGGGACCCCAGGGT TCGACCCCTGGGGCCAGGGAACCCTG GTCACCGTCTCCTCAG | 213 | TCCTATGAGCTGACACAGCCACCCTCAGT GTCAGTGGCCCCAGGAAAGACGGCCAGG ATTACCTGTGGGGAAAACAACATTGGAAG TAAAAGTGTGCACTGGTACCAGCAGAAGC CAGGCCAGGCCCCTGTGCTGGTCATCTAT TATGATAGCGACCGGCCCTCAGGGATCCC TGAGCGATTCTCTGGCTCCAACTCTGGGA ACACGGCCACCCTGACCATCAACAGGCTC GAAGCCGGGGATGAGGCCGACTATTACTG TCAGGTGTGGGATAGTAGTAGTGATCATG TGGTATTCGGCGGAGGGACCAAGCTGACC GTCCTAG | 214 |
| C021 | A-C021 | CAGGTGCAGCTGCAGGAGTCGGGCCC AGGACTGGTGAAGCCTTCACAGACCCT GTCCCTCACCTGCACTGTCTCTGGTGG CTCCATCAGCAGTGGTGGTTACTACTG GAGCTGGATCCGCCAGCACCCAGGGA AGGGCCTGGAGTGGATTGGGTACATCT ATTACAGTGGGAGCACCTACTACAACC CGTCCCTCAAGAGTCGAGTTACCATAT CAGTAGACACGTCTAAGAACCAGTTCT CCCTGAAGCTGAGCTCTGTGACTGCCG CGGACACGGCCGTGTATTACTGTGCGA GAGTTTGGCAATACTATGATAGTAGTG GTTCCTTTGACTACTGGGGCCAGGGAA CCCTGGTCACCGTCTCCTCAG | 215 | GATATTGTGATGACTCAGTCTCCACTCTCC CTGCCCGTCACCCCTGGAGAGCCGGCCT CCATCTCCTGCAGGTCTAGTCAGAGCCTC CTGCATAGTAATGGATACAACTATTTGGAT TGGTACCTGCAGAAGCCAGGGCAGTCTCC ACAGCTCCTGATCTATTTGGGTTCTAATCG GGCCTCCGGGGTCCCTGACAGGTTCAGT GGCAGTGGATCAGGCACAGATTTTACACT GAAAATCAGCAGAGTGGAGGCTGAGGATG TTGGGGTTTATTACTGCATGCAAGCTCTAC AAACTCCATTCACTTTCGGCCCTGGGACC AAAGTGGATATCAAAC | 216 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| C022 | A-C022 | CAGGTGCAGTTGCAGGAGTCGGGCCC AGGACTGGTGAAGCCTTCGGAGACCC TGTCCGTCACTTGCACTGTCTCTGGTG GCTCCATCAGCAGTAGTAGGTACTACT GGGGCTGGATCCGCCAGCCCCCAGGG AAGGGGCTGGAGTGGATTGGGAGTAT CTATTATAGTGGGAGCACCTACTACAA CCCGTCCCTCAAGAGTCGAGTCACCAT ATCCGTGGACACGTCCAAGAACCAGTT CTCCCTGAAGCTGAGCTCTGTGACCGC CGCAGACACGGCTGTGTATTACTGTGC GAGACATGCGGCAGCATACTATGATAG AAGTGGTTATTATTTCATCGAATACTTC CAGCACTGGGGCCAGGGCACCCTGGT CACCGTCTCCTCAG | 217 | GACATCCAGATGACCCAGTCTCCTTCCAC CCTGTCTGCATCTGTAGGAGACAGCGTCA CCATCACTTGCCGGGCCAGTCAGAGTATT AGTAGCTGGTTGGCCTGGTATCAGCAGAA ACCAGGGAAAGCCCCTAAGCTCCTGATCT ATAAGGCGTCTAGTTTAGAAAGTGGGGTC CCATCAAGGTTCAGCGGCAGTGGATCTGG GACAGAATTCACTCTCACCATCAGCAGCC TGCAGCCTGATGATTTTGCAACTTATTACT GCCAACAGTATAATAATTACCGGTACACTT TTGGCCAGGGGACCAAGCTGGAGATCAAAC | 218 |
| C027 | A-C027 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGGCATGCACT GGGTCCGCCAGGCTCCAGGCAAGGGG CTGGAGTGGGTGGCAGTTATATCATAT GATGGAAGTAATAAATACTATGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAAA GCAAGTGGAATTTATTGTAGTGGTGGA GACTGCTACTCATACTACTTTGACTACT GGGGCCAGGGAACCCTGGTCACCGTC TCCTCAG | 219 | GACATCCAGATGACCCAGTCTCCTTCCAC CCTGTCTGCATCTGTAGGAGACAGAGTCA CCATCACTTGCCGGGCCAGTCAGAGTATT AGTAGCTGGTTGGCCTGGTATCAGCAGAA ACCAGGGAAAGCCCCTAAGCTCCTGATCT ATAAGGCGTCTAGTTTAGAAAGTGGGGTC CCATCAAGGTTCAGCGGCAGTGGATCTGG GACAGAATTCACTCTCACCATCAGCAGCC TGCAGCCTGATGATTTTGCAACTTATTACT GCCAACAGTATAATAGTTATTCGACGTTCG GCCAAGGGACCAAGGTGGAAATCAAAC | 220 |
| C029 | A-C029 | CAGGTGCAGCTGCAGGAGTCGGGCCC AGGACTGGTGAAGCCTTCACAGACCCT GTCCCTCACCTGCACTGTCTCTGGTGG CTCCATCAGCAGTGGTGGTTACTACTG GAGCTGGATCCGCCAGCACCCAGGGA AGGGCCTGGAGTGGATTGGGTACATCT ATTACAGTGGGAGCACCTACTACAACC CGTCCCTCAAGAGTCGAGTTACCATAT CAGTAGACACGTCTAAGAACCAGTTCT CCCTGAAGCTGAGCTCTGTGACTGCCG CGGACACGGCCGTGTATTACTGTGCGA GAACAATGTATTACTATGATAGTAGTGG TTCCTTTGACTACTGGGGCCAGGGAAC CCTGGTCACCGTCTCCTCAG | 221 | GATATTGTGATGACTCAGTCTCCACTCTCC CTGCCCGTCACCCCTGGAGAGCCGGCCT CCATCTCCTGCAGGTCTAGTCAGAGCCTC CTGCATAGTAATGGATACAACTATTTGGAT TGGTACCTGCAGAAGCCAGGGCAGTCTCC ACAGCTCCTGATCTATTTGGGTTCTAATCG GGCCTCCGGGGTCCCTGACAGGTTCAGT GGCAGTGGATCAGGCACAGATTTTACACT GAAAATCAGCAGAGTGGAGGCTGAGGATG TTGGGGTTTATTACTGCATGCAAGCTCTAC AAACTCCTCACACTTTCGGCGGAGGGACC AAGGTGGAGATCAAAC | 222 |
| C030 | A-C030 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGGCATGCACT GGGTCCGCCAGGCTCCAGGCAAGGGG CTGGAGTGGGTGGCAGTTATATCATAT GATGGAAGTAATAAATACTATGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAAA GCAAGTGGAATATATTGTAGTGGTGGT AACTGCTACTCATACTACTTTGACTACT GGGGCCAGGGAACCCTGGTCACCGTC TCCTCAG | 223 | GACATCCAGATGACCCAGTCTCCTTCCAC CCTGTCTGCATCTGTAGGAGACAGAGTCA CCATCACTTGCCGGGCCAGTCAGAGTATT AGTAGCTGGTTGGCCTGGTATCAGCAGAA ACCAGGGAAAGCCCCTAAGCTCCTCATCT ATAAGGCGTCTAGTTTAGAAAGTGGGGTC CCATCAAGGTTCAGCGGCAGTGGATCTGG GACAGAATTCACTCTCACCATCAGCAGCC TGCAGCCTGATGATTTTGCAACTTATTACT GCCAACAGTATAATAGTTATTCGACGTTCG GCCAAGGGACCAAGGTGGAAATCAAAC | 224 |
| C031 | A-C031 | GAGGTGCAGCTGGTGGAGTCTGGGGG AGGCTTGGTACAGCCTGGGGGGTCCC TGAGACTCTCCTGTGCAGCCTCTGGAT TCACCTTCAGTAGCTACGACATGCACT GGGTCCGCCAAGCTACAGGAAAAGGT CTGGAGTGGGTCTCAGCTATTGGTACT GCTGGTGACACATACTATCCAGGCTCC GTGAAGGGCCGATTCACCATCTCCAGA | 225 | GACATCCAGATGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGGTCCTGATCTA TGCTGCATCCAGTTTGCAAAGTGGGGTCCC CATCAAGGTTCAGTGGCAGTGGATCTGGG ACAGATTTCACTCTCACCATCAGCAGTCTG | 226 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GAAAATGCCAAGAACTCCTTGTATCTTC AAATGAACAGCCTGAGAGCCGGGGAC ACGGCTGTGTATTACTGTGCAAGAGTA GGGTATGATAGTAGTGGTTATTCGGGC TGGTACTTCGATCTCTGGGGCCGTGGC ACCCTGGTCACCGTCTCCTCAG | | CAACCTGAAGATTTTGCAACTTACTACTGT CAACAGAGTTACAGTACCCCTCCGCTCAC TTTCGGCGGAGGGACCAAGGTGGAGATCA AAC | |
| C032 | A-C032 | GAGGTGCAGCTGGTGCAGTCTGGAGC AGAGGTGAAAAAGCCCGGGGAGTCTC TGAAGATCTCCTGTAAGGGTTCTGGAT ACAGCTTTACCAGCTACTGGATCGGCT GGGTGCGCCAGATGCCCGGGAAAGGC CTGGAGTGGATGGGGATCATCTATCCT GGTGACTCTGATACCAGATACAGCCCG TCCTTCCAAGGCCAGGTCACCATCTCA GCCGACAAGTCCATCAGCACCGCCTAC CTGCAGTGGAGCAGCCTGAAGGCCTC GGACACCGCCATGTATTACTGTGCGAG AGGGGTAGCAGTGGACTGGTACTTCG ATCTCTGGGGCCGTGGCACCCTGGTC ACCGTCTCCTCAG | 227 | CAGTCTGTGCTGACTCAGCCGCCCTCAGT GTCTGGGGCCCCAGGGCAGAGGGTCACC ATCTCCTGCACTGGGAGCAGCTCCAACAT CGGGGCAGGTTATGATGTACACTGGTACC AGCAGCTTCCAGGAACAGCCCCCAAACTC CTCATCTATGGTAACAGCAATCGGCCCTC AGGGGTCCCTGACCGATTCTCTGGCTCCA AGTCTGGCACCTCAGCCTCCCTGGCCATC ACTGGGCTCCAGGCTGAGGATGAGGCTG ATTATTACTGCCAGTCCTATGACAGCAGCC TGAGTGCCCTTTATGTCTTCGGAACTGGG ACCAAGGTCACCGTCCTAG | 228 |
| C036 | A-C036 | CAGGTGCAGCTACAGCAGTGGGGCGC AGGACTGTTGAAGCCTTCGGAGACCCT GTCCCGCACCTGCGCTGTCTTTGGTGG GTCCTTCACTAATTACTACTGGAGTTG GATCCGCCAGTCCCAGGGAAGGGGC TGGAGTGGATTGGGGAAATCAATGATA GTGGAATCACCAACTACAACCCGTCCC TCAAGAGTCGAGTCACCATCTCAGTAG ACACGTCCAAGAACCAGTTCTCCCTGA GCCTGAGGTCTGTGACCGCCGCGGAC ACGGCTGTGTATTACTGTGCCAGAAGG AGGTCCTTCTCTCGTCCTTCGTCTATC GACTACTGGGGCCAGGGAACCCTGGT CACCGTCTCCTCAG | 229 | GATATTGTGATGACTCAGTCTCCACTCTCC CTGCCCGTCACCCCTGGAGAGCCGGCCT CCATCCTGCAGGTCTAGTCAGAGCCTC CTGCATAGAAATGGATACAACTATTTGGAT TGGTACCTGCAGAAGCCAGGGCAGTCTCC ACAGCTCCTGATCTATTTGGGTTCCAATCG GGCCTCCGGGGTCCCTGACAGGTTCAGG GGCAGTGGATCAGGCACAGATTTCACACT GAAAATCAGCAGAGTGGAGGCTGAGGATG TTGGGGTTTATTACTGCATGCAAGCTCTAC AAACTCTCACCTTCGGCCAAGGGACACGA CTGGAGATTAAAC | 230 |
| C037 | A-C037 | TGCAGCTGGTGCAGTCTGGGCCTGAG GTGAAGAAGCCTGGGACCTCAGTGAA GGTCTCCTGCAAGGCTTCTGGATTCAC CTTTACTAGCTCTGCTATGCAGTGGGT GCGACAGGCTCGTGGACAACGCCTTG AGTGGATAGGATGGATCGTCGTTGCA GTGGTAACACAAACTACGCACAGAAGT TCCAGGAAAGAGTCACCATTACCAGGG ACATGTCCACAAGCACAGCCTACATGG AGCTGAGCAGCCTGAGATCCGAGGAC ACGGCCGTGTATTACTGTGCGGCCCCA TATTGTAGTGGTGGTAGCTGCAATGAT GCTTTTGATATCTGGGGCCAAGGGACA ATGGTCACCGTCTCTTCAG | 231 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGGTAGCTCACCGTGG ACGTTCGGCCAAGGGACCAAGGTGGAAAT CAAAC | 232 |
| C038 | A-C038 | AGGTGCAGCTGGTGGAGTCTGGGGGA GGCGTGGTCCAGCCTGGGAGGTCCCT GAGACTCTCCTGTGCAGCCTCTGGATT CACCTTCAATAGAATTGCCATGTACTG GGTCCGCCAGGCTCCAGGCAAGGGGC TGGAATGGGTGGCAGTTATATCATTTG ATGGAAGTTATGAATACTATGCAGAGT CCGTGAAGGGCCGGTTCGCCATCTCC AGAGACAATTCCAAGAACACGCTGTAT CTACAGATGAACAGCCTGAGAGCTGAG GACACGGCTGTCTATTACTGTGCGAAA AGTCCGATGGGTTATTGCACTAATGGT GTATGCTATCCTGACTCCTGGGGCCAG GGAACCCTGGTCACCGTCTCCTCAG | 233 | AATTTTATGCTGACTCAGCCCCACTCTGTG TCGGAGTCTCCGGGGAAGACGGTTACCAT CTCCTGCACCGGCAGCAGTGGCAGCATTG CCAGCAACTATGTGCAGTGGTACCAGCAG CGCCCGGGCAGTGCCCCCACCACTGTGA TCTATGAAGATACCCAAAGACCCTCTGGG GTCCCTGATCGGTTCTCTGGCTCCATCGA CAGCTCCTCCAATTCTGCCTCCCTCACCAT CTCTGGACTGAAGACTGAGGACGAGGCTG ACTACTACTGTCAGTCTTATGATATCAACA GTCGTTGGGTGTTCGGCGGAGGGACCAA GCTGACCGTCCTA | 234 |
| C040 | A-C040 | GAGGTGCAGCTGGTGGAGTCTGGGGG AGGCTTGGTAAAGCCTGGGGGGTCCC TTAGACTCTCCTGTGCAGCCTCTGGAT TCACTTTCAGTAACGCCTGGATGAGCT GGGTCCGCCAGGCTCCAGGGAAGGGG CTGGAGTGGGTTGGCCGTATTAAAAGC AAAACTGATGGTGGGACAACAGACTAC | 235 | TCCTATGAGCTGACTCAGCCACCCTCGGT GTCAGTGGCCCCAGGACAGACGGCCAGG ATTACCTGTGGGGGAAACAACATTGGAAG TAAAAGTGTGCACTGGTACCAGCAGAAGC CAGGCCAGGCCCCTGTGCTGGTCGTCTAT GATGATAGCGACCGGCCCTCAGGGATCCC TGAGCGATTCTCTGGCTCCAACTCTGGGA | 236 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GCTGCACCCGTGAAAGGCAGATTCACC ATCTCAAGAGATGATTCAAAAAACACG CTGTATCTGCAAATGAACAGCCTGAAA ACCGAGGACACAGCCGTGTATTACTGT ACCACAGATCCCCATTGTAGTAGTACC AGCTGCCCCATTTTTTACTACTACTACA TGGACGTCTGGGGCAAAGGGACCACG GTCACCGTCTCCTCAG | | ACACGGCCACCCTGACCATCAGCAGGGTC GAAGCCGGGGATGAGGCCGACTATTACTG TCAGGTGTGGGATAGTAGTAGTGATCAGG GGGTATTCGGCGGAGGGACCAAGCTGAC CGTCCTAG | |
| C101 | V-C001 | CAGGTGCAGCTGGTGGAGTCTGGAGG AGGCTTGATCCAGCCTGGGGGGTCCC TGAGACTCTCCTGTGCAGCCTCTGGGT TCATCGTCAGTAGCAACTACATGAGCT GGGTCCGCCAGGCTCCAGGGAAGGGG CTGGAGTGGGTCTCAGTTATTTATAGC GGTGGTAGCACATTCTACACAGACTCC GTGAAGGGCCGATTCACCATCTCCAGA GACAATTCCAAGAACACTCTGTATCTTC AAATGAACAGCCTGAGAGCCGAGGAC ACGGCCGTGTATTACTGTGTGCGGGAC TACGGTGACTTCTACTTTGACTACTGG GGCCAGGGAACCCTGGTCACCGTCTC CTCAG | 237 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCGGTGGGTC TGAGACAGACTTCACTCTCACCATCAGCA GACTGGAGCCTGAAGATTGTGCAGTGTAT TACTGTCAGCAGTATGGTAGCTCACCCCG GACGTTCGGCCAAGGGACCAAGGTGGAA ATCAAAC | 238 |
| C102 | V-C002 | CAGGTGCAGCTGGTGGAGTCTGGAGG AGGCTTGATCCAGCCTGGGGGGTCCC TGAGACTCTCCTGTGCAGCCTCTGGGT TCATCGTCAGTAGCAACTACATGAGCT GGGTCCGCCAGGCTCCAGGGAAGGGG CTGGAGTGGGTCTCAGTTATTTATAGC GGTGGTAGCACATTCTACGCAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGGG ACTACGGTGACTACTACTTTGACTACT GGGGCCAGGGAACCCTGGTCACCGTC TCCTCAG | 239 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTCTATT ACTGTCAGCAGTATGGTAGCTCACCTCGG ACGTTCGGCCAAGGGACCAAGGTGGAAAT CAAAC | 240 |
| C103 | V-C003 | CAGGTGCAGCTACAGCAGTGGGGCGC AGGACTGTTGAAGCCTTCGGAGACCCT GTCCCTCACCTGCGCTGTCTCTGGTGG GTCACTCAGTGGTTCTACTGGACCTG GATCCGCCAGCCCCAGGAAAGGGGC TGGAGTGGATTGGGGAAACCAATCATT TTTGGAAGCACCGGCTACAAGCCGTCC CTCAAGAGTCGAGTCACCATATCAGTA GACATGTCCAGGAACCAGTTCTCCCTG AAGGTGACCTCTGTGACCGCCGCGGA CACGGCTGTGTATTACTGTGCGAGAAA GCCCCTCCTCTACAGTGACTTCTCTCC TGGTGCTTTTGATATCTGGGGCCAAGG GACAATGGTCACCGTCTCTTCAG | 241 | GAAATTGTGTTGACGCAGTCTCCAGGCAC CCTGTCTTTGTCTCCAGGGGAAAGAGCCA CCCTCTCCTGCAGGGCCAGTCAGAGTGTT ACCGCCAACTACTTAGCCTGGTACCAGCA GAAACCTGGCCAGGCTCCCAGACTCCTCA TCTATGGTGCATCCAAGAGGGCCACTGGC ATCCCAGACAGGTTCAGTGGCAGTGGGTC TGGGACAGACTTCACTCTCAGCATCAGCA GACTGGAGCCTGAAGATTTTGCAGTGTATT ACTGTCAGCAGTATACTACTACACCTCGGA CTTTCGGCGGAGGGACCAAGGTGGAGAT CAAAC | 242 |
| C104 | V-C004 | CAGGTGCAGCTACAGCAGTGGGGCGC AGGACTGTTGAAGCCTTCGGAGACCCT GTCCCTCTCCTGCGCTGTCTATGGTGG GTCCCTCAGTGGTTACTACTGGAGCTG GATCCGCCAGCCCCAGGGAAGGGGC TGGAGTGGATTGGGAGATCAATCATT TTGGAAGCACCGGCTACAACCCGTCCC TCAAGAGTCGAGTCACCATCTCCGTGG ACACGTCCAAGAGCCAGTTCTCCGTGA AGCTGAGCTCTGTGACCGCCGCGGAC ACGGCTGTCTATTACTGCGCGAGAAAG CCCCTCCTCTACAGTAACTTATCCCCT GGTGCTTTTGATATCTGGGGCCAAGGG ACAATGGTCACCGTCTCTTCAG | 243 | GAAATTGTGTTGACGCAGTCTCCAGGCAC CGTGTCTTTGTCTCCAGGGGAAAGAGCCA CCCTCTCCTGCTGGGCCAGTCAGAGTGTT AGCGCCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGTA GACTGGAGCCTGAAGATTTTGCAGTATATT ACTGTCAGCAGTACGGTACTACACCTCGG ACTTTCGGCGGAGGGACCAAGGTGGAGAT CAAAC | 244 |
| C105 | V-C005 | CAGGTGCAGCTGGTGGAGTCTGGAGG AGGCTTGATCCAGCCTGGGGGGTCCC TGAGACTCTCCTGTGCAGCCTCTGGGT TCACCGTCAGTAGCAACTACATGAGCT GGGTCCGCCAGGCTCCAGGGAAGGGG | 245 | CAGTCTGCCCTGACTCAGCCTCCCTCCGC GTCGGGTCTCCTGGACAGTCAGTCACCA TCTCCTGCACTGGAACCAGCAGTGACGTT GGTGGTTATAAGTATGTCCTGGTACCAA CAGCACCCAGGCAAAGCCCCCAAACTCAT | 246 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | CTGGAGTGGGTCTCAGTTATTTATAGC GGTGGTAGTACATACTACGCAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGAG GCGAGGGGTGGGAGCTACCATACGAC TACTGGGGCCAGGGAACCCTGGTCAC CGTCTCCTCAG | | GATTTATGAGGTCAGTAAGCGGCCCTCAG GGGTCCCTGATCGCTTCTCTGGCTCCAAG TCTGGCAACACGGCCTCCCTGACCGTTTC TGGGCTCCAGGCTGAGGATGAGGCTGATT ATTACTGCAGCTCATATGAAGGCAGCAAC AATTTTGTGGTATTCGGCGGAGGGACCAA GCTGACCGTCCTAG | |
| C106 | V-C006 | CAGCTGCAGCTGCAGGAGTCGGGCCC AGGACTGGTGAAGCCTTCGGAGACCC TGTCCCTCACCTGCACTGTCTCTGGTG CCTCCGTCAGCAGTGGTAGTTACTACT GGAGCTGGATCCGGCAGCCCCCAGGG AAGGGACTGGAATGGATTGGGTATATC TATTACAGTGGGAGCACCAACTACAAC CCCTCCCTCAAGAGTCGAGTCACCATA TCAGTGGACACGTCCAAGAACCAGTTC TCCCTGAAGCTGAGCTCTGTGACCGCT GCGGACACGGCCGTGTATTACTGTGC GAGAGAGCGGCCCGGTGGAACGTATA GCAACACCTGGTACACCCCAACCGATA CCAACTGGTTCGACACCTGGGGCCAG GGAACCCTGGTCACCGTCTCCTCAG | 247 | TCCTATGAGCTGACACAGCCACCCTCAGT GTCAGTGGCCCCAGGAAAGACGGCCAGG ATTACCTGTGGGGGAAACAACATTGGAAG TAAAAGTGTGCACTGGTACCAGCAGAAGC CAGGCCAGGCCCCTGTGCTGGTCATCTAT TTTGATAGCGACCGGCCCTCAGGGATCCC TGAGCGATTCTCTGGCTCCAACTCTGGGA ACACGGCCACCCTGACCATCAGCAGGGTC GAAGCCGGGGATGAGGCCGACTATTACTG TCAGGTGTGGGATAGTAGTCGTGATCATG TGGTATTCGGCGGAGGGACCAAGCTGACC GTCCTAG | 248 |
| C107 | V-C007 | CAGGTTCAGCTGGTGCAGTCTGGAGCT GAGGTGAAGAAGCCTGGGGCCTCAGT GAGGGTCTCCTGCAAGGCTTCTGGTTA CACCTTTACCAGCTATGGTTTCAGCTG GGTGCGACAGGCCCCTGGACAAGGGC TTGAGTGGATGGGATGGATCAGCGCTT ACAATGGTAACACAAACTTTGCACAGA AGCTCCAGGGCAGAGTCACCATGACC ACAGACACATCCACGAGCACAGCCTAC ATGGAGCTGAGGAGCCTGAGATCTGA CGACACGGCCGTGTATTACTGTGCGAG AGGGGAAGCAGTGGCTGGTACAACCG GTTTTTTTGACTACTGGGGCCAGGGAA CCCTGGTCACCGTCTCCTCAG | 249 | CAGTCTGTGCTGACTCAGCCACCCTCAGC GTCTGGGACCCCCGGGCAGAGGGTCACC ATCTCTTGTTCTGGAAGCAGCTCCAACATC GGAAGTAATTATGTATACTGGTACCAGCAG CTCCCAGGAACGGCCCCCAAACTCCTCAT CTATAGGAATAATCAGCGGCCCTCAGGGG TCCCTGACCGATTCTCTGGCTCCAAGTCT GGCACCTCAGCCTCCCTGGCCATCAGTGG GCTCCGGTCCGAGGATGAGGCTGATTATT ACTGTGCAGCATGGGATGACAGCCTGAGT GGTTTTGTGGTATTCGGCGGAGGGACCAA GCTGACCGTCCTAG | 250 |
| C108 | V-C008 | CAGGTGCAGCTGCAGGAGTCGGGCCC AGGACTGGTGAAGCCTTCGGGGACCC TGTCCCTCACCTGCGCTGTCTCTGGTG GCTCCATCAGCAGTACTAACTGGTGGA GTTGGGTCCGCCAGCCCCCAGGGAAG GGGCTGGAGTGGATTGGGAAATCTAT CATACTGGGAGCACCAACTACAACCCG TCCCTCAAGAGTCGAGTCACCATATCA GTAGACAAGTCCAAGAACCAGTTCTCC CTGAAGCTGAGCTCTGTGACCGCCGC GGACACGGCCGTGTATTACTGTGTGAG AGATGGAGGACGACCCGGGGATGCTT TTGATATCTGGGGCCAAGGGACAATGG TCACCGTCTCTTCAG | 251 | CAGTCTGCCCTGACTCAGCCTGCCTCCGT GTCTGGGTCTCCTGGACAGTCGATCACCA TCTCCTGCACTGGAACCAGCAGTGACGTT GGTGGTTATAACTATGTCTCCTGGTACCAA CAACACCCAGGCAAAGCCCCCAAACTCAT GATTTATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAACTCATATACAAGCAGCAGCA CTCGAGTCTTCGGAACTGGGACCAAGGTC ACCGTCCTAG | 252 |
| C110 | V-C010 | CAGGTACAGCTGCAGCAGTCTGGAGC AGAGGTGAAAAAGCCCGGGGAGTCTC TGAAGATCTCCTGTAAGGGTTCTGGAT ACAGCTTTACCAGCTACTGGATCGGCT GGGTGCGCCAGATGCCCGGGAAAGGC CTGGAGTGGATGGGGATCATCTATCCT GGTGACTCTGATACCAGATACAGCCCG TCCTTCCAAGGCCAGGTCACCATCTCA GCCGACAAGTCCATCAGCACCGCCTAC ATGCAGTGGAGCAGCCTGAAGGCCTC GGACACCGCCATGTATTACTGTGCGAG ATCGTTCCGGGACGACCCCGTATAGC AGTGGCTGGCCCGGCTGATGCTTTTGA TATCTGGGGCCAAGGGACAATGGTCAC CGTCTCTTCAG | 253 | GACATCCAGATGACCCAGTCTCCTTCCAC CCTGTCTGCATCTGTAGGAGACAGAGTCA CCATCACTTGCCGGGCCAGTCAGAGTATT AGTTACTGGTTGGCCTGGTATCAGCAGAA ACCAGGGAAAGCCCCTAAGCTCCTGATCT ATCAGGCGTCTAGTTTAGAAAGTGGGGTC CCGTCAAGGTTCAGCGGCAGTGAGTCTGG GACAGAATTCACTCTCACCATCAGCAGCC TGCAGCCTGATGATTTTGCAACTTATTACT GCCAACAGTATAATAGTTACCCGTACACTT TTGGCCAGGGGACCAAGCTGGAGATCAAAC | 254 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| C112 | V-C012 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCCATGCTATGCACT GGGTCCGCCAGGCTCCAGGCAAGGGG CTGGAGTGGGTGGCAGTTATATCATAT GATGGAAGCAATAAATACTACGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAGA GAGGATTACTATGATAGTAGTGGTTCTT TTGACTACTGGGGCCAGGGAACCCTG GTCACCGTCTCCTCAG | 255 | CAGTCTGCCCTGACTCAGCCTGCCTCCGT GTCTGGGTCTCCTGGACAGTCGATCACCA TCTCCTGCACCGGAACCAGCAGTGACGTT GGTGGTTATAACTATGTCTCCTGGTACCAA CAACACCCAGGCAAAGCCCCCAAACTCAT GATTTATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAGCTCATATACAAGCAGCA CTTGGGTGTTCGGCGGAGGGACCAAGCT GACCGTCCTAG | 256 |
| C113 | V-C013 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAACTTTGGCATGCACT GGGTCCGCCAGGCTCCAGGCAAGGGG CTGGAGTGGGTGGCAGTTATATGGTAT GATGGAAGTAATAAATACTATGCAGAC TCCGTGAAGGGCCGATTCACCATCTCC AGAGACAATTCCAAGAACACGCTGTAT CTGCAAATGAACAGCCTGAGAGCCGA GGACACGGCTGTGTATTACTGTGCGAG AGGAGTAAACCCCGACGATATTTTGAC TGGCGTAGATGCTTTTGATATCTGGGG CCAAGGGACAATGGTCACCGTCTCTTC AG | 257 | GACATCCAGATGACCCAGTCTCCTTCCAC CCTGTCTGCATCTGTAGGAGACAGAGTCA CCATCACTTGCCGGGCCAGTCAGAGTATG AGTAGCTGGTTGGCCTGGTATCAGCAGAA ACCAGGGAACGCCCCTAAGCTCCTGATCT ATAAGGCGTCTAGTTTAGAAAGTGGGGTC CCATCAAGGTTCAGCGGCAGTGGATCTGG GACAGAATTCACTCTCACCATCAGCAGCC TGCAGCCTGATGATTTTGCAACTTATTACT GCCAACAGCATAATAGTTCCCCGCTCACTT TCGGCGGAGGGACCAAGGTGGAGATCAA AC | 258 |
| C114 | V-C014 | CAGGTGCAGCTGGTGGAGTCTGGAGG AGGGTTGATCCAGCCTGGGGGGTCCC TGAAACTCTCCTGTGTAGTCTCTGGGT TCACCGTCAGTAAGAACTACATCAGTT GGGTCCGCCAGGCTCCAGGCAAGGGG CTGGAATGGGTCTCAGTTATTTTTGCC GGTGGTAGTACATTCTACGCAGACTCC GTTAAGGGCCGATTCGCCATCTCCAGA GACAACTCCAACAACACGCTGTTTCTT CAAATGAACAGCCTGAGAGTCGAGGAC ACGGCCATTTATTACTGTGCGAGAGGG GACGGGGAGTTATTCTTTGACCAATGG GGCCAGGGAACCCTGGTCACCGTCTC CTCAG | 259 | CAGTCTGTGCTGACTCAGCCGCCCTCAGT GTCTGGGCCCCAGGGCAGAGGGTCACC ATCTCCTGCACTGGGACCAGTTCCAACAT CGGGGCAGGTTATGATGTGCACTGGTACC AGCAACTTCCTGGAAGAGCCCCCAAAGTC CTCATCTCTGGAAACAACATTCGGCCCTCA GAGGTCCCTGACCGATTCTCTGGCTCCAG GTCTGGCACCTCAGCCTCCCTGGCCATCA CTAGTCTCCAGCCTGAGGATGAGGCTCAA TATTACTGTCAGTCTTATGACAGCAGTCTC TATGCGGTGTTCGGCGGAGGGACCAAGCT GACCGTCCTA | 260 |
| C115 | V-C015 | CAGGTGCAGCTGGTGGAGTCTGGGGG AGGCTTGATAAAGCCAGGGCGGTCCC TGAGACTCTCTTGTACAGCCTCTGGAT TCACCTTTGGTGATTATGCTATGACCTG GTTCCGCCAGGCTCAGGGAAGGGGC TGGAGTGGGTAGGTTTCATTAGAAGTA AAGCTTATGGTGGGACAACAGGATACG CCGCGTCTGTGAAATACAGATTTACCA TCTCAAGAGATGATTCCAAAAGCATCG CCTATCTGCAAATGGACAGCCTGAAAA CCGAGGACACAGCCGTGTATTACTGTA CTAGGTGGGACGGGTGGAGTCAACAT GACTATTGGGGCCAGGGAACCCTGGT CACCGTCTCCTCAG | 261 | GATATTGTGATGACTCAGTCTCCACTCTCC CTGTCCGTCACCCCTGGAGAGCCGGCCTC CATCTCCTGCAGGTCTAGTCAGAGCCTCC TGCATAGTAATGGAAACAACTATTTCGATT GGTACCTGCAGAAGCCAGGGCAGTCTCCA CAGCTCCTGATCTATTTGGGTTCTAATCGG GCCTCCGGGGTCCCTGACAGGTTCAGTG GCAGTGGATCAGGCACAGATTTTACACTG AAGATCAGCAGAGTGGAGGCTGAGGATGT TGGGGTTTATTACTGCATGCAAGTTCTACA AATTCCGTACACTTTTGGCCAGGGGACCA AGCTGGAGATCAAAC | 262 |
| C116 | V-C016 | CAGGTGCAGCTGGTGGAGTCTGGGGG AGGCGTGGTCCAGCCTGGGAGGTCCC TGAGACTCTCCTGTGCAGCCTCTGGAT TCACCTACAGTACCTATGCTATGCACT GGGTCCGCCAGGCTCCAGGCAAGGGG CTGGAGTGGGTGGCATTTATATCATAT GATGGAAGCAATAAATACTACGCAGAC TCCGTGAAGGGCCGATTCACCATCTCC | 263 | AATTTTATGCTGACTCAGCCCCACTCTGTG TCGGAGTCTCCGGGGAAGACGGTAACCAT CTCCTGCACCGGCAGCAGTGGCAGCATTG CCAGCAACTATGTGCAGTGGTACCAGCAG CGCCCGGGCAGTGCCCCCACCACTGTGA TCTATGAGGATAACCAAAGACCCTCTGGG GTCCCTGATCGGTTCTCTGGCTCCATCGA CAGGTCCTCCAACTCTGCCTCCCTCACCA | 264 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
|  |  | AGAGACAATTCCAAGAACACGCTGTAT CTGCAAATGAACAGCCTGAGAGCTGAG GACACGGCTGTGTATTACTGTGCGAGA GATTTCTACCATAACTGGTTCGACCCC TGGGGCCAGGGAACCCTGGTCACCGT CTCCTCAG |  | TCTCTGGACTGAAGACTGAGGACGAGGCT GACTACTACTGTCAGTCTTATGATAGCGGC AATCATTGGGTGGTATTCGGCGGAGGGAC CAGGCTGACCGTCCTAG |  |
| C117 | V-C017 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTACCTATGCTATGCACT GGGTCCGCCAGGCTCCAGGCGAGGG GCTGGAGTGGGTGGCAGTTATTTCATA TGATGGAAGCAATACATACTACGCAGA CTCCGTGAAGGGCCGATTCACCATCTC CAGAGACAATTCCAAGAACACGCTGTA TCTGCAAATGAACAGCCTGAGAGCTGA AGACACGGCTGTGTATTACTGTGCGAG AGATCCCATATGGTTCGGGGAGTTATT ATCTCCTCCTTTTGTTCACTTTGACTAC TGGGGCCAGGGAACCCTGGTCACCGT CTCCTCAG | 265 | CAGTCTGTGCTGACTCAGCCGCCCTCAGT GTCTGCGGCCCCAGGACAGAAGGTCACC ATCTCCTGCTCTGGAAGCAGCTCCAACATT GGGAATAATTTGGTATCCTGGTACCAGCA GCTCCCAGGAACAGCCCCCAAACTCCTCA TCTATGAAATAATAAGCGACCCTCAGGGA TTCCTGACCGATTCTCTGGCTCCAAGTCTG GCACGTCAGCCACCCTGGGCATCACCGG ACTCCAGACTGGGGACGAGGCCGATTATT ACTGCGGAGCATGGGATAGCAGCCTGAGT GCTGGCGGGGTTTATGTCTTCGGAACTGG GACCAAGGTCACCGTCCTAG | 266 |
| C118 | V-C018 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAACTATGCTATGCACTG GGTCCGCCAGGCTCCAGGCAAGGGGC TGGAGTGGGTGGCAGTTATATCATATG ATGGAAGCAATAAATACTACGCAGACT CCGTGAAGGGCCGATTCACCATCTCCA GAGACAATTCCAAGAACACGCTGTATC TGCAAATGAACAGCCTGAGAGCTGAGG ACACGGCTATTTATTACTGTGCGAGTG GATATACTGGCTACGATTATTTTGTGCG GGGGACTACTACGGTCTGGACGTCT GGGGCCAAGGGACCACGGTCACCGTC TCCTCA | 267 | CAGCCTGTGCTGACTCAATCGCCCTCTGC CTCTGCCTCCCTGGGAGCCTCGGTCAAGC TCACCTGCACTCTGAGCAGTGGGCACAGC AGCTACGCCATCGCATGGCATCAGCAGCA GCCAGAGAAGGGCCCTCGGTACTTGATGA AGCTTAACACTGATGGCAGCCACAGCAAG GGGGACGGGATCCCTGATCGCTTCTCAGG CTCCAGCTCTGGGGCTGAGCGCTACCTCA CCATCTCCAGCCTCCAGTCTGAGGATGAG GCTGACTATTACTGTCAGACCTGGGGCAC TGGCATTCTCGTATTCGGCGGAGGGACCA AGCTGACCGTCCTAG | 268 |
| C119 | V-C019 | CAGGTCCAGCTGGTACAGTCTGGGGC TGAGGTGAAGAAGCCTGGGGCCTCAG TGAAGGTTTCCTGCAAGGCATCTGGAT ACACCTTCACCAGCTACTATATGCACT GGGTGCGACAGGCCCCTGGACAAGGG CTTGAGTGGATGGGAATAATCAACCCT AGTGGTGGTAGCACAAGCTACGCACA GAAGTTACAGGGCAGAGTCACCATGAC CAGGGACACGTCCACGAGCACAGTCT ACATGGAGCTGAGCAGCCTGAGATCTG AGGACACGGCCGTGTATTACTGTGCGA GAGCCAATCATGAAACAACTATGGACA CTTACTACTACTACTACATGGACGT CTGGGGCAAAGGGACCACGGTCACCG TCTCCTCA | 269 | CAGTCTGCCCTGACTCAGCCTGCCTCCGT GTCTGGGTCTCCTGGACAGTCGATCACCA TCTCCTGCACTGGAACCAGCAGTGACGTT GGTGGTTATAAGTATGTCTCCTGGTACCAA CGGCACCCAGGCAAAGCCCCCAAACTCAT GATATATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAGCTCATACACAAGCAGCAGC ACTTCTGTGGTGTTCGGCGGAGGGACCCA GCTGACCGTCCTAG | 270 |
| C120 | V-C020 | GAGGTGCAGCTGGTGGAGTCTGGAGG AGGCTTGATCCAGCCTGGGGGGTCCC TGAGACTCTCCTGTGCAGCCTCTGGGT TCACCGTCAGTAGCAACTACATGACCT GGGTCCGCCAGGCTCCAGGGAAGGGG CTGGAGTGGGTCTCACTTATTTATCCC GGTGGTAGCACATACTACGCAGACTCC GTGAAGGGCCGATTCACCATCTCCAGA GACAATTCCAAGAACACGCTGTATCTT CAAATGAACAGCCTGAGAGCCGAGGA CACGGCCGTCTATTACTGTGCGAGAGA GGGTATGGGTATGGCAGCAGCTGGTA CGTGGGGCCAGGGAACCCTGGTCACC GTCTCCTCAG | 271 | GCCATCCGGATGACCCAGTCTCCATCCTC CCTGTCTGCATCTGTAGGAGACACAGTCA CCATCACTTGCCAGGCGAGTCAGGACATT AGCAAGTATTTAAATTGGTATCAGCAGAAA CCAGGGAAAGCCCCTAAGCTCCTGATCTA CGATGCATCCAATTTGGAAACAGGGGTCC CATCAAGGTTCAGTGGAAGTGGATCTGGG ACAGATTTTACTTTCACCATCAGCAGCCTG CAGCCTGAAGATATTGCAACATATTACTGT CAACAGTATGATAATCTCCCTCAGACTTTC GGCGGAGGGACCAAGGTGGAGATCAAAC | 272 |
| C121 | V-C021 | CAGGTGCAGCTGGTGCAGTCTGGGGC TGAGGTGAAGAAGCCTGGGGCCTCAG TGAAGGTCTCCTGCAAGGCTTCTGGAT ACACCTTCACCGGCTACTATATGCACT | 273 | CAGTCTGCCCTGACTCAGCCTGCCTCCGT GTCTGGGTCTCCTGGACAGTCGATCACCA TCTCCTGCACTGGAACCAGCAGTGATGTT GGGAGTTATAACCTTGTCTCCTGGTACCAA | 274 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GGGTGCGACAGGCCCCTGGACAAGGG CTTGAGTGGATGGGATGGATCAGCCCT GTCAGTGGTGGCACAAACTATGCACAG AAGTTTCAGGGCAGGGTCACCATGACC AGGGACACGTCCATCAGCACAGCCTAC ATGGAGCTGAGCAGGCTGAGATCTGA CGACACGGCCGTGTATTACTGTGCGAG AGCCCCACTGTTCCCCACAGGGGTGC TAGCTGGGGACTACTACTACTACGGTA TGGACGTCTGGGGCCAAGGGACCACG GTCACCGTCTCCTCA | | CAGCACCCAGGCAAAGCCCCCAAACTCAT GATTTATGAGGGCAGTAAGCGGCCCTCAG GGGTTTCTAATCGCTTCTCTGGCTCCAAGT CTGGCAACACGGCCTCCCTGACAATCTCT GGACTCCAGGCTGAGGACGAGGCTGATTA TTACTGCTGCTCATATGCAGGTAGTAGCAC TTTGGTATTCGGCGGAGGGACCAAGCTGA CCGTCCTAG | |
| C122 | V-C022 | GAGGTGCAGCTGGTGGAGTCTGGAGG AGGCTTGATCCAGCCTGGGGGGTCCC TGAGACTCTCCTGTGCAGCCTCTGGGC TCACCGTCAGTAGCAACTACATGAGCT GGGTCCGCCAGGCTCCAGGGAAGGGG CTGGAGTGGGTCTCAGTTCTTTATAGC GGTGGTAGCTCATTCTACGCAGACTCC GTGAAGGGCCGATTCACCATCTCCAGA GACAATTCCAAGAACACGCTGTATCTT CAAATGAACAGCCTGAGAGCCGAAGAC ACGGCCGTGTATTACTGTGCGAGAGAA AGTGGGGATACAACTATGGCCTTTGAC TACTGGGGCCAGGGAACCCTGGTCAC CGTCTCCTCAG | 275 | GACATCCAGTTGACCCAGTCTCCATCCTTC CTGTCTGCATCTGTAGGAGACAGAGTCAC CATCACTTGCCGGGCCAGTCAGGGCATTA GCAGTTATTTAGCCTGGTATCAGCAAAAAC CAGGGAAAGCCCCTAAGCTCCTGATCTAT GCTGCATCCACTTTGCAAAGTGGGGTCCC ATCAAGGTTCAGCGGCAGTGGATCTGGGA CAGAATTCACTCTCACAATCAGCAGCCTG CAGCCTGAAGATTTTGCAACTTATTACTGT CAACAGCTTAATAGTGACTCGTACACTTTT GGCCAGGGGACCAAGCTGGAGATCAAAC | 276 |
| C123 | V-C023 | GAGGTGCAGCTGGTGGAGTCTGGAGG AGGCTTGATCCAGCCTGGGGGGTCCC TGAGACTCTCCTGTGCAGCCTCTGGG TCACCGTCAGTAGGAACTACATGAGCT GGGTCCGCCAGGCTCCAGGGAAGGGG CTGGAGTGGGTCTCAGTTATTTATAGC GGTGGTAGCACATACTACGCAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGAGA TCTATCTGCTGCTTTTGATATCTGGGG CCAAGGGACAATGGTCACCGTCTCTTC AG | 277 | GACATCCAGTTGACCCAGTCTCCATCCTTC CTGTCTGCATCTGTAGGAGACAGAGTCAC CATCACTTGCCGGGCCAGTCAGGGCATTA GCAGTTATTTAGCCTGGTATCAGCAAAAAC CAGGGAAAGCCCCTAAGCTCCTGATCTAT GCTGCATCCACTTTGCAAAGTGGGGTCCC ATCAAGGTTCAGCGGCAGTGGATCTGGGA CAGAATTCACTCTCACAATCAGCAGCCTG CAGCCTGAAGATTTTGCAACTTATTACTGT CAACAGCTTAATAGTTACCCTCCAGCCTTC GGCCAAGGGACACGACTGGAGATTAAAC | 278 |
| C124 | V-C024 | GAGGTGCAGCTGGTGGAGTCTGGGGG AGGCTTGGTACAGCCTGGGGGGTCCC TGAGACTCTCCTGTGCAGCCTCTGGAT TCACCTTCAGTGGCTATAGCATGAACT GGGTCCGCCAGGCTCCAGGGAAGGGG CCGGAGTGGGTTTCATACATTAGTAGG AGTAGTAGTACCATATACTACGCAGAC TCTGTGAAGGGCCGATTCACCATCTCC AGAGACAATGCCAAGAACTCACTGTAT CTGCAAATGAACAGCCTGAGAGACGAG GACACGGCTGTGTATTACTGTGCGAGA GAAGGGGCTAGAGTGGGAGCTACATA TGACACGTACTACTTTGACTACTGGGG CCAGGGAACCCTGGTCACCGTCTCCTC AG | 279 | GAAATTGTGTTGACACAGTCTCCAGCCAC CCTGTCTTTGTCTCCAGGGGAAAGAGCCA CCCTCTCCTGCAGGGCCAGTCAGAGTTTT AGCAGCTACTTAGCCTGGTACCAACAGAA ACCTGGCCAGGCTCCCAGGCTCCTCATCT ATGATGCATCCAACAGGGCCACTGGCATC CCAGCCAGGTTCAGTGGCAGTGGGTCTG GGACAGACTTCACTCTCACCATCAGCAGC CTAGAGCCTGAAGATTTTGCAGTTTATTAC TGTCAGCAGCGTAACAACTGGCCTCCCGA GTGGACGTTCGGCCAAGGGACCAAGGTG GAAATCAAAC | 280 |
| C125 | V-C025 | CAGGTGCAGCTGGTGCAGTCTGGGCC TGAGGTGAAGAAGCCTGGGACCTCAG TGAAGGTCTCCTGCAAGGCTTCTGGAT TCACCTTTACTAGCTCTGCTGTGCAGT GGGTGCGACAGGCTCGTGGACAACGC CTTGAGTGGATAGGATGGATCGTCGTT GGCAGTGGTAACACAAACTACGCACAG AAGTTCCAGGAAAGAGTCACCATTACC AGGGACATGTCCACAAGCACAGCCTAC ATGGAGCTGAGCAGCCTGAGATCCGA GGACACGGCCGTGTATTACTGTGCGG CACCTTATTGTAGTGGTGGTAGCTGCT CTGATGCTTTTGATATCTGGGGCCAAG GGACAATGGTCACCGTCTCTTCAG | 281 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGGTAGCTCACCGTGG ACGTTCGGCCAAGGGACCAAGGTGGAAAT CAAAC | 282 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| C126 | V-C026 | CAGGTGCAGCTGCAGGAGTCGGGCCC AGGACTGGTGAAGCCTTCGGAGACCC TGTCCCTCTCCTGCGCTGTCTCTGGTG GCTCCATCGGTAGTTACTTCTGGAGCT GGATCCGGCAGCCCCCAGGGAAGGGA CTGGAGTGGATTGGATATCTCCATTAC AGTGGGAGCACCAACTACAACCCCTCC CTGAAGAGTCGAGTCACCATATCAGTA GACACGTCCAAGAATCAGTTCTCCCTG AAGCTGAGCTCTGTGACCGCTGCGGA CACGGCCGTGTATTACTGTGCGAGATT GCAGTGGCTACGCGGAGCTTTTGATAT CTGGGGCCAAGGGACAATGGTCACCG TCTCTTCAG | 283 | AATTTTATGCTGACTCAGCCCCACTCTGTG TCGGAGTCTCCGGGGAAGACGGTAACCAT CTCCTGCACCGGCAGCAGTGGCAGCATTG CCAGCAACTATGTGCAGTGGTACCAGCAG CGCCCGGGCAGTGCCCCCACCACTGTGA TCAATGAAGATAACCAAAGACCCTCTGGG GTCCCTGATCGGTTCTCTGGCTCCATCGA CAGCTCCTCCAACTCTGCCTCCCTCACCA TCTCTGGACTGAAGACTGAGGACGAGGCT GACTACTGTCAGTCTTATGATAGCAGC AATTTGGTATTCGGCGGAGGGACCAAGCT GACCGTCCTAG | 284 |
| C127 | V-C027 | CAGGTGCAGCTGGTGCAGTCTGGGGC TGAGGTGAAGAAGCCTGGGGCCTCAG TGAAGGTCTCCTGCAAGGCTTCTGGAT ACACCTTCACCGGCTACTATATGCACT GGGTGCGACAGGCCCCTGGACAAGGG CTTGAGTGGATGGGATGGATCAACCCT AACAGTGGTGGCACAAACTATGCACAG AAGTTTCAGGGCAGGGTCACCATGACC AGGGACACGTCCATCAGCACAGCCTAC ATGGAGCTGAGCAGGCTGAGATCTGA CGACACGGCCGTGTATTACTGTGCGAC GGCGCACCCCCGGAGGATCCAAGGGG TATTTTTTTTGGGGCCGGGCGTCTGGG GCCAAGGGACCACGGTCACCGTCTCC TCA | 285 | CAGTCTGTGCTGACTCAGCCACCCTCAGC GTCTGGGACCCCCGGGCAGAGGGTCACC ATCTCTTGTTCTGGAAGCAGCTCCAACATC GGAAGTAATACTGTAAACTGGTACCAGCA GCTCCCAGGAACGGCCCCAAACTCCTCA TCTATAGTAATAATCAGCGGCCCTCAGGG GTCCCTGACCGATTCTCTGGCTCCAAGTC TGGCACCTCAGCCTCCCTGGCCATCAGTG GGCTCCAGTCTGAGGATGAGGCTGATTAT TACTGTGCAGCATGGGATGACAGCCTGAA TGGCGTGGTATTCGGCGGAGGGACCAAG CTGACCGTCCTAG | 286 |
| C128 | V-C028 | GAGGTGCAGCTGTTGGAGTCTGGGGG AGGCTTGGTACAGCCTGGGGGGTCCC TGAGACTCTCCTGTGCAGCCTCTGGAT TCACCTTTAGCACCTATGCCATGAGTT GGGTCCGCCAGGCTCCAGGGAAGGGG CTGGAGTGGGTCTCAACTATTACTGGT AGTGGTCGTGACACATACTACGCAGAC TCCGTGAAGGGCCGGTTCACCATCTCC AGAGACAATTCCAAGAACACGCTGTTT CTGCAACTGAACAGCCTGAGAGCCGA GGACGCGGCCGTGTATTCCTGTGCGA ACCACCCTCTGGCATCAGGCGACGACT ACTACCACTACTACATGGACGTCTGGG GCAAAGGGACCACGGTCACCGTCTCC TCA | 287 | GAAATTGTGTTGACGCAGTCTCCAGGCAC CCTGTCTTTGTCTCCAGGGGAAAGAGCCA CCCTCTCCTGCAGGGCCAGTCAGAGTGTT AACAGCAGGCAGTTAGCCTGGTACCAGCA GAAACCTGGCCAGGCTCCCAGGCTCCTCA TCTATGGTGCGTCCAGCAGGGCCACTGGC ATCCCAGAGAGGTTCAGTGGCAGTGGATC TGGGACAGACTTCACTCTCACCATCAGCA GACTGGAGTCTGAAGATTTTGCAGTGTATC ACTGTCAGCAATATGGTAGCTCAAGGGCG CTCACTTTCGGCGGAGGGACCAAGGTGGA GATCAAAC | 288 |
| C129 | V-C029 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGGCATGAACT GGGTCCGCCAGGCTCCAGGCAAGGGG CTGGAGTGGGTGGCAGTTATATCATAT GATGGAAGTAATACATACTATACAGACT CCGTGAAGGGCCGATTCACCATCTCCA GAGACAATTCCAAGAACACGCTGTATC TGCAAATGAACAGCCTGAGAGTTGACG ACACGGCTACATATTACTGTGCGAAAG GGCCCCGGTTTGGCTGGAGCTATAGA GGGGGGTCTGGTTTTGATATCTGGGG CCAAGGGACAATGGTCACCGTCTCTTC AG | 289 | GACATCCAGATGACCCAGTCTCCATCCTC CCTGTCTGCATCTGTAGGAGACAGAGTCA CCATCACTTGCCAGGCGAGTCAGGACATT AGCAACTATTTAAATTGGTATCAGCAGAAA CCAGGGAAAGCCCCTAAGCTCCTGATCTA CGATGCATCCAATTTGGAAACAGGGGTCC CATCAAGGTTCAGTGGAAGTGAATCTGGG ACAGATTTTACTTTCACCATCAGCAGCCTG CAGCCTGAAGATATTGCAACATATTACTGT CAACAGTATGATAATCTCCCGATCACCTTC GGCCAAGGGACACGACTGGAGATTAAAC | 290 |
| C130 | V-C030 | CAGGTGCAGCTGGTGCAGTCTGGGGC TGAGGTGAAGAAGCCTGGGGCCTCAG TGAAGGTTTCCTGCAAGGCATCTGGAT ACACCTTCACCAACTACTATATGCACTG GGTGCGACAGGCCCCTGGACAAGGGC TTGAGTGGATGGGAATAATCAACCCTA GTGGTGGTAGCACAGGCTACGCACAG AAGTTCCAGGGCAGAGTCACCATGACC AGGGACACGTCCACGAGCACAGTCTA CATGGAGCTGAGCAGCCTGAGATCTGA | 291 | TCCTATGAGCTGACACAGCCACCCTCAGT GTCAGTGGCCCCAGGAAAGACGGCCAGG ATTACCTGTGGGGGAAACAACATTGGAAG TAAAAGTGTGCACTGGTACCAGCAGAAGC CAGGCCAGGCCCCTGTGCTGGTCATCTAT GATAGCGACCGGCCCTCAGGGATCCC TGAGCGATTCTCTGGCTCCAACTCTGGGA ACACGGCCACCCTGACCATCAGCAGGGTC GAAGCCGGGGATGAGGCCGACTATTACTG TCAGGTGTGGGATAGTAGTAGTGATCATC | 292 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GGACACGGCCGTGTATTACTGTGCGA GATCCCGACCGACTCCTGACTGGTACT TCGATCTCTGGGGCCGTGGCACCCTG GTCACCGTCTCCTCAG | | CGGGGGTGGTATTCGGCGGAGGGACCAA GCTGACCGTCCTAG | |
| C131 | V-C031 | CAGGTGCAGCTGGTGCAGTCTGGGTC TGAGGTGAAGAAGCCTGGGTCCTCGG TGAAGGTCTCCTGCAAGGCTTCTGGAG GCACCTTCAGCAGCTATGCTTTCAGCT GGGTGCGACAGGCCCCTGGACAAGGG CTTGAGTGGATGGGAAGGATCATCCCT ATCCTTGCTTTAGCAAACTACGCACAG AAGTTCCAGGGCAGAGTCACGATTACC GCGGACAAATCCACGAGCACAGCCTA CATGGAGCTGAGCAGCCTGAGATCTGA GGACACGGCCGTGTATTACTGTGCGA GAGTCAATCAAGCAGTAACTACTCCCT TCTCCATGGACGTCTGGGGCCAAGGG ACCACGGTCACCGTCTCCTCA | 293 | GAAATAGTGATGACGCAGTCTCCAGCCAC CCTGTCTGTGTCTCCAGGGGAAAGAGCCA CCCTCTCCTGCAGGGCCAGTCAGAGTGTT AGCAGCAACTTAGCCTGGTACCAGCAGAA ACCTGGCCAGGCTCCCAGGCTCCTCATCT ATGGTGCATCCACCAGGGCCACTGGTATC CCAGCCAGGTTCAGTGGCAGTGGGTCTG GGACAGAGTTCACTCTCACCATCAGCAGC CTGCAGTCTGAAGATTTTGCAGTTTATTAC TGTCAGCAGTATAATAACTGGCCGATCAC CTTCGGCCAAGGGACACGACTGGAGATTA AAC | 294 |
| C132 | V-C032 | CAGGTGCAGCTGCAGGAGTCGGGCCC AGGACTGGTGAAGCCTTCGGGGACCC TGTCCCTCACCTGCGCTGTCTCTGGTG GCTCCATCAGCAGTAATAACTGGTGGA GTTGTGTCCGCCAGCCCCCAGGGAAG GGGCTGGAGTGGATTGGGGAAATCTAT CATAGTGGGAGCACCAACTACAACCCG TCCCTCAAGAGTCGAGTCACCATATCA GTAGACAAGTCCAAGAACCAGTTCTCC CTGAAGCTGAGCTCTGTGACCGCCGC GGACACGGCCGTGTATTACTGTGCGA GAGGGGGGGATACAGCTATGGGCCCC GAATACTTTGACTACTGGGGCCAGGGA ACCCTGGTCACCGTCTCCTCAG | 295 | CAGTCTGCCCTGACTCAGCCTGCCTCCGT GTCTGGGTCTCCTGGACAGTCGATCACCA TCTCCTGCACTGGAACCAGCAGTGACGTT GGTGGTTATAACTATGTCTCCTGGTACCAA CAACACCCAGGCAAAGCCCCCAAACTCAT GATTTATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAGCTCATATACAAGCAGCAGCA CTCTTTTGTTCGGCGGAGGGACCAAGCTG ACCGTCCTAG | 296 |
| C133 | V-C033 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGCTATGCACT GGGTCCGCCAGGCTCCAGGCAAGGGG CTGGAGTGGGTGGCAGTTATATTTATAT GATGGAAGCAATAAATACTACGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAGA GATTCGGACGTAGATACATCTATGGTT ACTTGGTTCGACTACTGGGGCCAGGG AACCCTGGTCACCGTCTCCTCAG | 297 | GACATCCAGATGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCTCCGTGGAC GTTCGGCCAAGGGACCAAGGTGGAAATCA AAC | 298 |
| C134 | V-C034 | GAGGTGCAGCTGTTGGAGTCTGGGGG AGGCTTGGTACAGCCTGGGGGGTCCC TGAGACTCTCCTGTGCAGCCTCTGGAT TCACCTTTAGCAACTATGCCATGAGCT GGGTCCGCCAGGCTCCAGGGAAGGGG CTGGAGTGGGTCTCAGCTATTAGTGGT AGTGATGGTAGCACATACTACGCAGGC TCCGTGAAGGGCCGGTTCACCATCTCC AGAGACAATTCCAAGAACACACTGTAT CTGCAAATGAACAGCCTGAGAGCCGA GGACACGGCCGTATATTACTGTGCGAA AGATCCCCTTATAACTGGACCTACCTAT CAATACTTTCACTACTGGGGCCAGGGA ACCCTGGTCACCGTCTCCTCAG | 299 | TCCTATGAGCTGACACAGCCACCCTCAGT GTCAGTGGCCCCAGGAAAGACGGCCAGG ATTACCTGTGGGGGAAACAACATTGGAAG TAAAAGTGTGCACTGGTACCAGCAGAAGC CAGGCCAGGCCCCTGTGCTGGTCATCTAT TATGATAGCGACCGGCCCTCAGGGATCCC TGAGCGATTCTCTGGCTCCAACTCTGGGA ACACGGCCACCCTGACCATCAGCAGGGTC GAAGCCGGGGATGAGGCCGAATATCACTG TCAGGTGTGGGATAGTAGTAGTGATCGTC CGGGGGTGGTTTTCGGCGGAGGGACCAA GCTGACCGTCCTAG | 300 |
| C135 | V-C035 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGCTATGCACT GGGTCCGCCAGGCTCCAGGGAAGGGG CTGGAGTGGGTGGCAGTTATACCATTT GATGGAAGAAATAAGTACTACGCAGAC TCCGTGACGGGCCGATTCACCATCTCC AGAGACAATTCCAAGAACACACTGTAT | 301 | GACATCCAGATGACCCAGTCTCCTTCCAC CCTGTCTGCATCTGTAGGAGACAGAGTCA CCATCACTTGCCGGGCCAGTCAGAGTATT AGTAACTGGTTGGCCTGGTTTCAGCAGAA ACCAGGGAAAGCCCCTAAGCTCCTGATCT ATGAGGCGTCTAGTTTAGAAAGTGGGGTC CCATCAAGGTTCAGCGGCAGTGGATCTGG GACAGAATTCACTCTCACCATCAGCAGCC TGCAGCCTGATGATTTTGCAACTTATTACT | 302 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | CTGCAAATGAACAGCCTGAGAGCTGAG GACACGGCTGTGTATTACTGTGCGAGT AGTAGTGGTTATCTTTTCCACTCTGACT ACTGGGGCCAGGGAACCCTGGTCACC GTCTCCTCAG | | GCCAACAGTATAATAGTTATCCGTGGACGT TCGGCCAAGGGACCAAGGTGGAGATCAAAC | |
| C138 | V-C038 | GAGGTGCAGCTGGTGGAGTCTGGGGG AGGCTTGGTCCAGCCTGGGGGGTCCC TGAGACTCTCCTGTGCAGCCTCTGGAT TCACCTTTAGTACCTATTGGATGAGCT GGGTCCGCCAGCCTCCAGGGAAGGGG CTGGAGTGGGTGGCCAACATAAAGCAA GATGGAAGTGAGAAATACTATGTGGAT TCTGTGAAGGGCCGATTCACCATCTCC AGAGACAACGCCAAGAACTCACTGTAT CTGCAAATGAACAGCCTGAGAGCCGAC GACACGGCCGTGTATTACTGTGCCGG GGGGACATGGCTACGATCCTCTTTTGA CTACTGGGGCCAGGGAACCCTGGTCA CCGTCTCCTCAG | 303 | AATTTTATGCTGACTCAGCCCCACTCTGTG TCGGAGTCTCCGGGGAAGACGGTAACCAT CTCCTGCACCGGCAGCAGTGGCAGCATTG CCAGCAACTATGTGCAGTGGTACCAGCAG CGCCCGGGCAGTGCCCCCACCACTGTGA TCTATGAGGATAACCAAAGACCCTCTGGG GTCCCTGATCGGTTCTCTGGCTCCATCGA CAGCTCCTCCAACTCTGCCTCCCTCACCA TCTCTGGACTGAAGACTGAGGACGAGGCT GACTACTACTGTCAGTCTTATGATAGCAGC AATTGGGTGTTCGGCGGAGGGACCAAGCT GACCGTCCTA | 304 |
| C139 | V-C039 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGCCATGCACT GGGTCCGCCAGGCTCCAGGCAAGGGG CTGGAGTGGGTGGCAGTTATATCATAT GATGGAAGTAATAAATACTCTGCAGAC TCCGTGAAGGGCCGATTCACCATCTCC AGAGACAATTCCAAGAACACGCTGTAT CTGCAAATGAACAGCCTGAGAGCTGAG GACACGGCTGTGTATTACTGTGCGAAA GGGGGGGCCTACAGCTACTACTACTAC ATGGACGTCTGGGGCAAAGGGACCAC GGTCACCGTCTCCTCA | 305 | GACATCCAGATGACCCAGTCTCCATCCTC CCTGTCTGCATCTGTAGGAGACAGAGTCA CCATCACTTGCCAGGCGAGTCAGGACATT AGCAACTATTTAAATTGGTATCAGCAGAAA CCAGGGAAAGCCCCTAAGCTCCTGATCTA CGATGCATCCAATTTGGAAACAGGGGTCC CATCAAGGTTCAGTGAAGTGGATCTGGG ACAGATTTTACTTTCACCATCAGCAGCCTG CAGCCTGAAGATATTGCAACATATTACTGT CAACAGTATGATAATCTCCCGCTCACTTTC GGCGGAGGGACCAAGGTGGAAATCAAAC | 306 |
| C140 | V-C040 | GAGGTGCAGCTGGTGGAGTCTGGGGG AGGCTTGGTCCAGCCTGGGGGGTCCC TGAGACTCTCCTGTGCAGCCTCTGGAG TCACCGTCAGTAGCAACTACATGAGCT GGGTCCGCCAGCCTCCAGGGAAGGGG CTGGAGTGGGTCTCACTTATTTATAGC GGTGGTAGCACATTCTACGCAGACTCC GTGAAGGGCAGATTCACCATCTCCAGA GACAATTCCGAGAACACGCTGTATCTT CAAATGAACACCCTGAGAGCCGAGGA CACGGCTGTGTATTACTGTGCGAGAGA TCTGTATTACTACGGTATGGACGTCTG GGGCCAAGGGACCACGGTCACCGTCT CCTCA | 307 | GACATCCAGTTGACCCAGTCTCCATCCTTC CTGTCTGCATCTGTAGGAGACAGAGTCAC CATCACTTGCCGGGCCAGTCAGGGCATTA GCAGTTATTTAGCCTGGTATCAGCAGAAAC CAGGGAAAGCCCCTAAGCTCCTGATCTAT GCTGCATCCACTTTGCAAAGTGGGGTCCC ATCAAGGTTCAGCGGCAGTGGATCTGGGA CAGAATTCACTCTCACAATCAGCAGCCTG CAGCCTGAAGATTTTGCAACTTATTACTGT CAACAGCTTAATAGTTACTCTTACACTTTT GGCCAGGGGACCAAGCTGGAGATCAAAC | 308 |
| C141 | V-C041 | GAGGTGCAGCTGGTGGAGTCTGGGGG AGGCGTGGTCCAGCCTGGGAGGTCCC TGAGACTCTCCTGTGCAGCCTCTGGAT TCACCTTCAGTAGCTATGCTATGTTCTG GGTCCGCCAGGCTCCGGGCAAGGGGC TGGAGTGGGTGGCAGTTATATCATATG ATGGAAGCAATAAATACTACGCAGACT CCGTGAAGGGCCGATTCACCATCTCCA GAGACAATTCCAAGAACACGCTGTATC TGCAAATGAACAGCCTGAGAGCTGAGG ACACGGCTGTGTATTACTGTGCGAGGG CGGATTTAGGATATTGTACTAATGGTGT ATGCTATGTTGACTACTGGGGCCAGGG AACCCTGGTCACCGTCTCCTCA | 309 | AATTTTATGCTGACTCAGCCCCACTCTGTG TCGGAGTCTCCGGGGAAGACGGTAACCAT CTCCTGCACCGGCAGCAGTGGCAGCATTG CCAGCAACTATGTGCAGTGGTACCAGCAG CGCCCGGGCAGTGCCCCCACCACTGTGA TCTATGAGGATAACCAAAGACCCTCTGGG GTCCCTGATCGGTTCTCTGGCTCCATCGA CAGCTCCTCCAACTCTGCCTCCCTCACCA TCTCTGGACTGAAGACTGAGGACGAGGCT GACTACTACTGTCAGTCTTATGATAGCAGC AATTGGGTGTTCGGCGGAGGGACCAAGCT GACCGTCCTAG | 310 |
| C143 | V-C043 | GAGGTGCAGCTGGTGGAGTCTGGGGG AGGCTTGGTCCAGCCGGGGGGGTCCC TGAGACTCTCCTGTGCAGCCTCTGGAT TCAGTGTCAGCACCAAGTACATGACAT GGGTCCGTCAGGCTCCAGGGAAGGGG CTGGAGTGGGTCTCAGTTCTTTACAGC GGTGGTAGTGATTACTACGCAGACTCC GTGAAGGGCAGATTCACCATCTCCAGA | 311 | CAGTCTGCCCTGACTCAGCCTGCCTCCGT GTCTGGGTCTCCTGGACAGTCGATCACCA TCTCCTGCACTGGAACCAGCAATGATGTT GGGAGTTATACCCTTGTCTCCTGGTACCA ACAGTACCCAGGCAAAGCCCCCAAACTCT TAATTTTTGAGGGCACTAAGCGGCCTCA GGGATTTCTAATCGCTTCTCTGGTTCCAAG TCTGGCAACACGGCCTCCCTGACAATCTC | 312 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | GACAATTCCAAGAACGCTTTATATCTTC AAATGAACAGCTTGAGAGTCGAGGACA CGGGTGTTTATTACTGTGCCAGAGACT CGTCGGAAGTCCGTGACCACCCCGGG CACCCAGGGCGCTCGGTGGGGCTTT TGATATCTGGGGCCAAGGGACAATGGT CACCGTCTCTTCAG | | TGGGCTCCAGGGTGAAGACGAGGCTGATT ATTATTGCTGCTCATATGCAGGTGCTAGCA CTTTCGTGTTCGGCGGAGGGACCAAGCTG ACCGTCCTAG | |
| C144 | V-C044 | GAGGTGCAGCTGGTGGAGTCTGGAGG AGGCTTGATCCAGCCTGGGGGGTCCC TGAGACTCTCCTGTGCAGCCTCTGGGT TCACCGTCAGTAACAACTACATGAGCT GGGTCCGCCAGGCTCCAGGGAAGGGG CTGGAGTGGGTCTCAGTTATTTATAGC GGTGGTAGCACATACTACGCAGACTCC GTGAAGGGCCGATTCACCATCTCCAGA GACAAATCCAAGAACACGCTGTATCTT CAAATGAACAGGCTGAGAGCCGAGGA CACGGCCGTGTATTATTGTGCGAGAGA AGGGGAGGTAGAAGGGTATAACGATTT TTGGAGTGGTTATTCTAGAGACCGTTA CTACTTTGACTACTGGGGCCAGGGAAC CCTGGTCACCGTCTCCTCAG | 313 | CAGTCTGCCCTGACTCAGCCTGCCTCCGT GTCTGGGTCTCCTGGACAGTCGATCACCA TCTCCTGCACTGGAACCAGCAGTGACGTT GGTGGTTATAACTATGTCTCCTGGTACCAA CAACACCCAGGCAAAGCCCCCAAACTCAT GATTTATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAGCTCATATACAAGCAGCAGCA CTCGAGTCTTCGGAACTGGGACCAAGGTC ACCGTCCTAG | 314 |
| C145 | V-C045 | GAGGTGCAGCTGGTGGAGTCTGGAGG AGGCTTGATCCAGCCTGGGGGGTCCC TGAGACTCTCCTGTGCAGCCTCTGGGT TCAGCGTCAGTAGCAACTACATGAGCT GGGTCCGCCAGGCTCCAGGGAAGGGG CTGGAGTGGGTCTCAGTTATTTATAGC GGTGGTAGTACATACTACGCAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGAGA AGGGGAGGTAGAAGGGTATTACGATTT TTGGAGTGGTTATTCTAGAGACCGTTA CTACTTTGACTACTGGGGCCAGGGAAC CCTGGTCACCGTCTCCTCAG | 315 | CAGTCTGCCCTGACTCAGCCTGCCTCCGT GTCTGGGTCTCCTGGACAGTCGATCACCA TCTCCTGCACTGGAACCAGCAGTGACGTT GGTGGTTATAACTATGTCTCCTGGTACCAA CAACACCCAGGCAAAGCCCCCAAACTCAT GATTTATGATGTCAGTAATCGGCCCTCAG GGGTTTCTAATCGCTTCTCTGGCTCCAAGT CTGGCAACACGGCCTCCCTGACCATCTCT GGGCTCCAGGCTGAGGACGAGGCTGATT ATTACTGCAGCTCATATACAAGCAGCACCA CTCGAGTCTTCGGAACTGGGACCAGGGTC ACCGTCCTAG | 316 |
| C146 | V-C046 | GAGGTGCAGCTGGTGGAGTCTGGGGG AGGCCTGGTCAAGCCTGGGGGGTCCC TGAGACTCTCCTGTGCAGCCTCTGGAC TCACCTTCACTGCCTATAGAATGAATTG GGTCCGCCAGGCTCCAGGGAAGGGGC TGGAGTGGCTCTCATCAATTAGTAATA CAAATGGCGACATATACTATGCAGACT CAGTGAAGGGCCGATTCACCATCTCCA GAGACAACGCCAAGAATTCTCTGTATC TGCAAATGAACAGCCTGAGGGCCGAC GACACGGCTGTATATTACTGTGCGAGA GATGTTGCATCTAACTACGCTTACTTTG ACCTTTGGGGCCAGGGAACCCTGGTC ACCGTCTCCTCAG | 317 | CAGTCTGCCCTGACTCAGCCTGCCTCCGT GTCTGGGTCTCCTGGACAGTCGATCACCA TCTCCTGCACTGGAACCAGCAGTGACATT GGTGTTTATAACTATATCTCCTGGAGCCAA CAACACCCAGGCAAAGCCCCCAAAGTCAT GATTTATGATGTCACTAATCGGCCCTCAGG GGTTTCTAATCGCTTCTCTGGCTCCAAGTC TGGCAACACGGCCTCCCTGACCATCTCTG GGCTCCAGGCTGAGGACGAGGCTGATTAT TATTGCAGCTCATATAGAGGCAGCAGCAC TCCCTATGTCTTCGGAACTGGGACCAAGG TCACCGTCCTAG | 318 |
| C147 | V-C047 | GAGGTGCAGCTGGTGCAGTCTGGAGC AGAGGTGAAAAAGCCCGGGGAGTCTC TGAAGATCTCCTGTAAGGGTTCTGGAT ACAGATTTACCAACTACTGGATCGGCT GGGTGCGCCAGATGCCCGGGAAAGGC CTGGAGTGGATGGGGATCATCTATCCT GGTGACTCTGATACCAGATACAGCCCG TCCTTCAAGGCCAGGTCACCATCTCA GCCGACAAGTCCATCACCACCGCCTAC CTGCAGTGGAGCAGCCTGAAGGCCTC GGACACCGCCATGTATTACTGTGCGAG ACTCAGTGACCGCTGGTACAGTCCGTT CGACCCCTGGGGCCAGGGAACCCTGG TCACCGTCTCCTCAG | 319 | CAGGCTGTGGTGACCCAGGAGCCCTCACT GACTGTGTCCCAGGAGGGACAGTCACTC TCACCTGTGGCTCCAGCACTGGAGCTGTC ACCAGTGGTCATTATCCCTACTGGTTCCAG CAGAAGTCTGGCCAAGCCCCCAGGACACT GATTTATGAAACAAGCATCAAACACTCCTG GACCCCTGCCCGGTTCTCAGGCTCCCTCC TTGGGGGCAAAGCTGCCCTGACCCTTTCG GGTGCGCAGCCTGAGGATGAGGCTGATTA TTACTGTTGCTCTCCTATAGTGGTGCTCG GCCGGTGTTCGGCGGAGGGACCAAGCTG ACCGTCCTAG | 320 |
| C148 | V-C048 | GAGGTGCAGCTGGTGGAGTCTGGGGG AGGCTTGGTCCAGCCTGGGGGGTCCC AGAGACTCTCCTGTGCAGCCTCTGGAT TCACCGTCAGTAGCAATTACATGAGCT GGATCCGCCAGGCTCCAGGGAAGGGG | 321 | GAAATAGTGATGACGCAGTCTCCAGCCAC CCTGTCTGTGTCTCCAGGGGAAAGAGCCA CCCTCTCCTGCAGGGCCAGTCAGAGTGTT AGCAGCCACTTAGCCTGGTACCAGCAGAA ACCTGGCCAGGCTCCCAGGCTCCTCATCT | 322 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | CTGGAGTGGGTCTCAGTTATTTATAGC GGTGGTAGCGCATACTACGTAGACTCC GTGAAGGGCAGATTCACCATCTCCAGA GACAATTCCAAGAACACCCTGTATCTT CAAATGAACAGCCTGAGACCCGAGGA CACGGCTGTGTATTACTGTGCGAGAAT CGCAAACTACATGGACGTCTGGGGCAA AGGGACCACGGTCACCGTCTCCTCA | | ATGGTGCATCCACCAGGGCCACTGGTATC CCAACCAGGTTCAGTGGCAGTGGGTCTGG GACAGAGTTCACTCTCACCATCAGCAGCC TGCAGTCTGAAGATTTTGCAGTTTATTACT GCCAGCAGTATAATAACTGGCCTCCGCTC ACTTTCGGCGGAGGGACCAAGGTGGAGAT CAAAC | |
| C149 | V-C049 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTACCTATGGCATGCACT GGGTCCGCCAGGCTCCAGGCAAGGGG CTGGAGTGGGTGGCCGTTATATCATAT GATGGAAGTAATAAATACTTTGCAGACT CCGTGAAGGGCCGATTCACCATCTCCA GAGACAATTCCAAGAACACGCTTTATC TGCAAATGAACAGCCTGAGACCTGAGG ACACGGCTGTATATTACTGTGCGAAAG TGGGGATGGAGTACAGCAGTGGCTGG TACGGGGAAGAAATTGACTTCTGGGGC CAGGGAACCCTGGTCACCGTCTCCTCAG | 323 | GACATCCAGATGACCCAGTCTCCATCCTC CCTGTCTGCATCTGTAGGAGACAGAGTCA CCATCACTTGCCGGGCAAGTCAGAGCATT AGCAGTTATTTAAATTGGTATCAGCAGAAA CCAGGGAAAGTCCCTAAGCTCCTGATCTA TGCTGCATCCAGTTTGCAAAGTGGGGTCC CATCAAGGTTCAGTGGCAGTGGATCTGGG ACAGACTTCACTCTCACCATCAGCAGTCTG CAACCTGAAGATTTTGCAACTTACTACTGT CAACAGAGTTACAGAACCCCGCTCACTTT CGGCGGAGGGACCAAGGTGGAGATCAAAC | 324 |
| C150 | V-C050 | GAGGTGCAGCTGGTGGAGTCCGGGGG AGGCTTAGTTCAGCCTGGGGGGTCCC TGAGACTCTCCTGTGTAGCCTCTGGAT TCACCTTCAGTAGCTACTGGATGCACT GGGTCCGCCAAGTCCCAGGGAAGGGG CCGGTGTGGGTCTCACATATTAACAGT GAAGGGAGTAGCACAAACTACGCGGA CTCCGTGAGGGCCGATTCACCATCTC CAGAGACAACGCCAAGGACACGGCTATA TCTTCAAATGAACAATCTGAGAGCCGA GGACACGGCTGTATATTACTGTGCAAG ACCGACGGCTGTAGCAGCAGCTGGCA ATTACTTCTACTACACGGTATGGACGT CTGGGGCCAAGGGACCACGGTCACCG TCTCCTCA | 325 | CAGTCTGCCCTGACTCAGCCTGCCTCCGT GTCTGGGTCTCCTGGACAGTCGATCACCA TCTCCTGCACTGGAACCAGCAGTGACGTT GGTTATTATAACTTTGTCTCCTGGTACCAA CAACACCCAGGCAAAGCCCCCAAACTCAT GATTTATGAGGTCAGTAATCGGCCCTCTG GGGTTTCTAATCGCTTCTCTGGCTCCAAGT CTGGCAACACGGCCTCCCTGATCATCTCT GGGCTCCAGGCTGAGGACGAGGCTGATT ATTACTGCAGCTCATATAGAAGCAGCAGC ACTCTGGTGTTCGGCGGGGGGACCAAGC TGACCGTCCTAG | 326 |
| C151 | V-C051 | CAGGTGCAGCTGGTGGAGTCTGGGGG AGGCCTGGTCAAGCCTGGGGGGTCCC TGAGACTCTCCTGTGCAGCCTCTGGAT TCACCTTCAGTAGCTATAACATGAACTG GGTCCGCCAGGCTCCAGGGAAGGGGC TGGAGTGGGTCTCATGCATTAGTAGTA GTAGTAGTTACATATACTACGCAGACT CAGTGAAGGGCCGATTCACCATCTCCA GAGACAACGCCAAGAACTCACTGTATC TGCAAATGAACAGCCTGAGAGCCGAG GACACGGCTGTGTATTACTGTGCGAGA GAGAGGGGTATGACGGTTGGTAAAAC CCCCCCATTTCTTGGGGGCCAGGGAA CCCTGGTCACCGTCTCCTCAG | 327 | AATTTTATGCTGACTCAGCCCCACTCTGTG TCGGAGTCTCCGGGGAAGACGGTAACCAT CTCCTGCACCGGCAGCAGTGGCAGCATTG CCAGCAACTATGTGCAGTGGTACCAGCAG CGCCCGGGCAGTGCCCCCACCACTGTGA TCTATGAGGATAACCAAAGACCCTCTGGG GTCCCTGATCGGTTCTCTGGCTCCATCGA CAGCTCCTCCAACTCTGCCTCCCTCACCA TCTCTGGACTGAAGACTGAGGACGAGGCT GACTACTACTGTCAGTCTTATGATAGCAGC AATTATTGGGTGTTCGGCGGAGGGACCAA GCTGACCGTCCTAG | 328 |
| C152 | V-C052 | CAGGTTCAGCTGGTGCAGTCTGGAGCT GAGGTGAAGAAGCCTGGGGCCTCAGT GAAGGTCTCCTGCAAGGCTTCTGGTTA CACCTTTACCAGCTACGGTATCAGCTG GGTGCGACAGGCCCCTGGACAAGGGC TTGAGTGGATGGGATGGATCAGCGCTT ACAATGGTAACACAAACTATGCACAGA AGCTCCAGGGCAGAGTCACCATGACC ACAGACACATCCACGAGCACAGCCTAC ATGGAGCTGAGGAGCCTGAGATCGA CGACACGGCCGTGTTTTACTGTGCGAG AGATCGGGGGGGCACGATTTTTGGA GTGGTTATGGGTTCTACTACTACTACG GTATGGACGTCTGGGGCCAAGGGACC ACGGTCACCGTCTCCTCA | 329 | GACATCCAGATGACCCAGTCTCCATCCTC CCTGTCTGCATCTGTAGGAGACAGAGTCA CCATCACTTGCCGGGCGAGTCAGGGCATA AGCAATTACTTAGCCTGGTATCAGCAGAG ACCAGGGAAAGTTCCTAAGCTCCTGATCTT TGCTGCATCCACTTTGCAATCAGGGGTCC CATCTCGGTTCAGTGGCAGTGGATCTGGG ACAGATTTCACTCTCACCATCAGCAGCCTG CAGCCTGAAGATGTTGCAACTTATTACTGT CAAAAGTATAACAGTGCCCCTCGGACGTT CGGCCAAGGGACCAAGGTGGAAATCAAAC | 330 |
| C153 | V-C053 | GAGGTGCAGCTGGTGGAGTCTGGAGG AGGCTTGATCCAGCCTGGGGGGTCCC TGAGACTCTCCTGTGCAGCCTCTGGGT | 331 | CAGTCTGCCCTGACTCAGCCTGCCTCCGT GTCTGGGTCTCCTGGACAGTCGATCACCA TCTCCTGCACTGGAACCAGCAGTGATGTT | 332 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | TCACCGTCAGTAGCAACTACATGAGCT GGGTCCGCCAGGCTCCAGGGAAGGGG CTGGAGTGGGTCTCAGTTATTTATAGC GGTTATAGCACATACTACGTAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGAGT GGGGGGAGCACATAGTGGCTACGACG GATCCTTTGACTACTGGGGCCAGGGAA CCCTGGTCACCGTCTCCTCAG | | GGGAGTTATAACCTTGTCTCCTGGTACCAA CAGCACCCAGGCAAAGCCCCCAAACTCAT GATTTATGAGGGCAGTAAGCGGCCCTCAG GGGTTTCTAATCGCTTCTCTGGCTCCAAGT CTGGCAACACGGCCTCCCTGACAATCTCT GGGCTCCAGGCTGAGGACGAGGCTGATT ATTACTGCTGCTCATATGCAGGTAGTAGCA CTTGGGTGTTCGGCGGAGGGACCAAGCT GACCGTCCTAG | |
| C154 | V-C054 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTCGCTATGGCATGCACT GGGTCCGCCAGGCTCCAGGCAAGGGG CTGGAGTGGGTGGCAGTTATGTCATAT GATGGAAGTAGTAAATACTATGCAGAC TCCGTGAAGGGCCGATTCACCATCTCC AGAGACAATTCCAAGAACACGCTGTGT CTGCAAATGAACAGCCTGAGAGCTGAG GACACGGCTGTGTATTACTGTGCGAAA CAGGCGGGCCCATATTGTAGTGGTGG TAGCTGCTACTCCGCGCCCTTTGACTA CTGGGGCCAGGGAACCCTGGTCACCG TCTCCTCAG | 333 | GACATCCAGATGACCCAGTCTCCATCCTC CCTGTCTGCATCTGTAGGAGACAGAGTCA CCATCACTTGCCAGGCGAGTCAGGGCATT AGCAACTATTTAAATTGGTATCAGCAGAAA CCAGGGAAAGCCCCTAAGCTCCTGATCTA CGATGCATCCAATTTGGAAACAGGGGTCC CATCAAGGTTCAGTGGAAGTGGATCTGGG ACAGATTTTACTTTCACCATCAGCAGCCTG CAGCCTGAAGATATTGCAACATATTACTGT CAACAGTATGATAATCTCCCGATCACCTTC GGCCAAGGGACACGACTGGAGATTAAAC | 334 |
| C155 | V-C055 | GAGGTGCAGCTGGTGGAGTCTGGAGG AGGCTTGATCCAGCCTGGGGGGTCCC TGAGACTCTCCTGTGCAGCCTCTGGGT TCATCGTCAGTAGCAACTACATGAGCT GGGTCCGCCAGGCTCCAGGGAAGGGC CTGGAGTGGGTCTCAGTTATTTATAGC GGTGGTAGCACATTCTACGCAGACTCC GTGAAGGGCCGATTCACCATCTCCAGA GACAATTCCAAGAACACGCTGTATCTT CAAATGAACAGCCTGAGAGCCGAGGA CACGGCCGTGTATTACTGTGCGAGAGA TTTTGGAGAGTTCTACTTTGACTACTGG GGCCAGGGAACCCTGGTCACCGTCTC CTCAG | 335 | GAAATAGTGATGACGCAGTCTCCAGCCAC CCTGTCTGTGTCTCCAGGGGAAAGAGCCA CCCTCTCCTGCAGGGCCAGTCAGAGTGTT AGCAGCAACTTAGCCTGGTACCAGCAGAA ACCTGGCCAGGCTCCCAGGCTCCTCATCT ATGGTGCATCCACCAGGGCCACTGCTATC CCAGCCAGGTTCAGTGGCAGTGGGTCTG GGACAGAGTTCACTCTCACCATCAGCAGC CTGCAGTCTGAAGATTTTGCAGTTTATTAC TGTCAGCAGTATAATAACTGGCCTCGGAC GTTCGGCCAAGGGACCAAGGTGGAGATCA AAC | 336 |
| C156 | V-C056 | CAGGTGCAGCTGGTGGAGTCTGGGGG AGGCGTGGTCCAGCCTGGGAGGTCCC TGAGACTCTCCTGTGCAGCCTCTGGAT TCACCTTCAGTAACTATGGCATGCACT GGGTCCGCCAGGCTCCAGGCAAGGGG CTGGAGTGGGTGGCAGTTATATCATAT GATGGAAATAATAAATACTATGCAGACT CCGTGAAGGGCCGATTCACCATCTCCA GAGACAATTCCAAGAACACGCTGTATC TGCAAATGAACAGCCTGAGAGCTGAGG ACACGGCTGTGTATTACTGTGCGAAAG ATCCTTTCCCCTTAGCAGTGGCTGGGA CGGGCTACTTTGACTACTGGGGCCAG GGAACCCTGGTCACCGTCTCCTCAG | 337 | TCCTATGAGCTGACTCAGCCACCCTCGGT GTCAGTGGCCCCAGGACAGACGGCCAGG ATTTCCTGTGGGGGAAACAACATTGGAAG TAAAAATGTGCACTGGTACCAGCAGAAGC CAGGCCAGGCCCCTGTGCTGGTCGTCTAT GATGATAGCGACCGGCCCTCAGGGATCCC TGAGCGATTCTCTGGCTCCAACTCTGGGA ACACGGCCACCCTGACCATCAGCAGGGTC GAAGCCGGGGATGAGGCCGACTATTACTG TCAGGTGTGGGATAGTAGTAGTGATCCTT GGGTGTTCGGCGGAGGGACCAAGCTGAC CGTCCTAG | 338 |
| C160 | V-C060 | CAGGTTCAGCTGGTGCAGTCTGGAGCT GAGGTGAAGAAGCCTGGGGCCTCAGT GAAGGTCTCCTGCAAGGCTTCTGGTTA CACCTTTACCAGCTACGGTATCAGCTG GGTGCGACAGGCCCCTGGACAAGGGC TTGAGTGGATGGGATGGATCAGCGCTT ACAATGGTAACACAAACTATGCACAGA AGCTCCAGGGCAGAGTCACCATGACC ACAGACACATCCACGAGCACAGCCTAC ATGGAGCTGAGGAGCCTGAGATCTGA CGACACGGCCGTGTATTACTGTGCGAG AGTTCCCGCCTCGTACGGTGACGACG ATTACTACTACTACTACGGTATGGACGT CTGGGGCCAAGGGACCACGGTCACCG TCTCCTCA | 339 | TCCTATGAGCTGACACAGCCACCCTCGGT GTCAGTGTCCCAGGACAGACGGCCAGG ATCACCTGCTCTGGAGATGCATTGCCAAA GCAATATGCTTATTGGTACCAGCAGAAGC CAGGCCAGGCCCCTGTGCTGGTGATATAT AAAGACAGTGAGAGGCCCTCAGGGATCCC TGAGCGATTCTCTGGCTCCAGCTCAGGGA CAACAGTCACGTTGACCATCAGTGGAGTC CAGGCAGAAGACGAGGCTGACTATTACTG TCAATCAGCAGACAGCAGTGGTACTCTTT GGGTGTTCGGCGGAGGGACCAAGCTGAC CGTCCTAG | 340 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| C161 | V-C061 | CAGGTGCAGCTACAGCAGTGGGCGCAGGACTGTTGAAGCCTTCGGAGACCCTGTCTCTCACCTGCGCTGTCTCTGGTGGGTCACTCAGTGGTTTCTACTGGACCTGGATCCGCCAGCCCCCGGAAAGGGGCTGGAGTGGATTGGGGAAACCAATCATTTTGGAAGCACCGACTACAAGCCGTCCCTCAAGAGTCGAGTCACCATATCAGTAGACATGTCCAGGAACCAATTTTCCCTGATTTATGACCTCTGTGACCGCCGCGGACACGGCTGTGTATTACTGTGCGAGAAAGACCCTCCTCTTCAGTGACTTTTCTCCTGGTGCTTTTGATATCTGGGGCCAAGGGACAATGGTCACCGTCTCTTCAG | 341 | GAAATTGTGTTGACGCAGTCTCCAGGCACCCTGTCTTTGTCTCCAGGGGAAAGAGCCACCCTCTCCTGCAGGGCCAGTCAGACTCTTACCGCCAACTACTTAGCCTGGTACCAGCAGAAACCTGGCCAGGCTCCCAGACTCCTCATCTATGGTGCATCCAAGAGGGCCACTGGCATCCCAGACAGGTTCAGTGGCAGTGGGTCTGGGACAGACTTCACTCTCAGCATCAGCAGACTGGAGCCTGAAGATTTTGCAGTGTATTACTGTCAGCAGTATGGTACTACACCTCGGACTTTCGGCGGAGGGACCAAGGTGGAAATCAA | 342 |
| C162 | V-C062 | CAGGTGCAGCTACAGCAGTGGGCGCAGGACTGTTGAAGCCTTCGGAGACCCTGTCCCTCACCTGCGCTGTCTCTGGTGGGTCACTCAGTGGTTTCTACTGGACCTGGATCCGCCAGCCCCCAGGAAAGGGGCTGGAGTGGATTGGGGAAACCAATCATTTTGGAAGCACCGACTACAAGGCGTCCCTCAAGAGTCGAGTCACCATATCAGTAGGCATGTCCAGGAACCAATTTTCCCTGAAGGTGACTTCTCTGACCGCCGCGGACACGGCTGTGTATTACTGCGCGAGAAAGCCCCTCCTCTACAGTGACTTTTCTCCTGGTGCTTTTGATGTCTGGGGCCAAGGGACAATGGTCACCGTCTCTTCAG | 343 | GAAATTGTGTTGACGCAGTCTCCAGGCACCCTGTCTTTGTCTCCAGGGGAAAGAGCCACCCTCTCCTGCAGGGCCAGTCAGACTCTTACCGCCAACTACTTAGCCTGGTACCAGCAGAAACCTGGCCAGGCTCCCAGACTCCTCATCTATGGTGCATCCAAGAGGGCCGCTGGCATCCCAGACAGGTTCAGTGGCAGTGGGTCTGGGACAGACTTCACTCTCAGCATCACCAGACTGGAGCCTGAAGATTTTGCAGTGTATTACTGTCAGCAGTATCATACTACACCTCGGACTTTCGGCGGAGGGACCAAGGTGGAGATCAA | 344 |
| C163 | V-C063 | CAGGTGCAGCTACAGCAGTGGGCGCAGGACTGTTGAAGCCTTCGGAGACCCTGTCCCTCACCTGCGCTGTCTCTGGTGGGTCACTCAGTGGTTTCTACTGGACCTGGATCCGCCAGCCCCCAGGAAAGGGGCTGGAGTGGATTGGGGAAACCAATCATTTTGGAAGCACCGACTACAAGCCGTCCCTCAAGAGTCGAGTCACCATATCAGTAGACATGTCCAGGAACCAGTTCTCCCTGAAGGTGACCTCTGTGACCGCCGCGGACACGGCTGTTTATTACTGTGCGAGAAAGCCCCTCCTCCACAGTGACTTATCTCCTGGTGCTTTTGATATCTGGGGCCAAGGGACAATGGTCACCGTCTCTTCAG | 345 | GAAATTGTGTTGACGCAGTCTCCAGGCACCCTGTCTTTGTCTCCAGGGGAAAGAGCCACCCTCTCCTGCAGGGCCAGTCAGACTCTTCCGCCAACTACTTAGCCTGGTACCAGCAGAAAGCTGGCCAGGCTCCCAGACTCCTCATCTATGGTGCATCCAAGAGGGCCACTGGCATCCCAGACAGGTTCAGTGGCAGTGGGTCTGGGACAGACTTCACTCTCAGCATCACCAGACTGGAGCCTGAAGATTTTGCTGTGTATTACTGTCAGCAGTATGTTACTACACCTCGGACTTTCGGCGGAGGGACCAAGGTGGAAATCAA | 346 |
| C164 | V-C064 | GAGGTGCAGCTGGTGGAGTCTGGGGGAGGCTTGGTCCAGCCGGGGGGGTCCCTGAGACTCTCCTGTGCAGCCTCTGGATTCAGTGTCAGCACCAAGTACATGACATGGGTCCGTCAGGCTCCAGGGAAGGGGCTGGAGTGGGTCTCAGTTCTTTACAGCGGTGGTAGTGATTACTACGCAGACTCCGTGAAGGGCAGATTCACCATCTCCAGAGACAATTCCAAGAACGCTTATATCTTCAAATGAACAGCTTGAGAGTCGAGGACACGGGTGTTTATTACTGTGCCAGAGACTCGTCGGAAGTCCGTGACCACCCCGGGCACCCAGGGCGCTCGGTGGGGCTTTTGATATCTGGGGCCAAGGGACAATGGTCACCGTCTCTTCAG | 347 | CAGTCTGCCCTGACTCAGCCTGCCTCCGTGTCTGGGTCTCCTGGACAGTCGATCACCATCTCCTGCACTGGAACCAGCAATGATGTTGGGAGTTATACCCTTGTCTCCTGGTACCAACAGTACCCAGGCAAAGCCCCCAAGCTCTTAATTTTTGAGGTCACTAAGCGGTCCTCAGGGATTTCTAATCGCTTCTCTGGTTCCAAGTCTGGCAACACGGCCTCCCTGACAATCTCTGGGCTCCAGGGTGAAGACGAGGCTGATTATTGCTGCTCATATGCAGGTGCTAGCACTTTCGTGTTCGGCGGAGGGACCAAGCTGACCGTCCTAG | 348 |
| C165 | V-C065 | CAGGTGCAGCTGGTGCAGTCTGGGGCTGAGGTGAAGAAGCCTGGGTCGTCGGTGAAGGTCTCCTGCAAGGCTTCTGGAGGCACCTTCAGTAGCTATGCTATCAACTGGGTGCGACAGGCCCCTGGACAAGGGCTTGAGTGGATGGGAAGGATCATCCCTATCGTTGGTATAGCAAACTACGCACAGAAGTTCCAGGGCAGAGTCACGATTACGGCGGACAAATCCTCGAGCACAGCCTAC | 349 | GAAATTGTGTTGACGCAGTCTCCAGGCACCCTGTCTTTGTCTCCAGGGGAAAGAGCCACCCTCTCCTGCAGGGCCAGTCAGAGTGTTAGCAGCACCTACTTAGCCTGGTACCAGCAGAAACCTGGCCAGGCTCCCAGGCTCCTCATCTATGGTGCATCCAGCAGGGCCACTGGCATCCCAGACAGGTTCAGTGGCAGTGGGTCTGGGACAGACTTCACTCTCACCATCAGCAGACTGGAGCCTGAAGATTTTGCAGTGTATT | 350 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | ATGGAGCTGAGCAGCCTGAGATCTGA GGACACGGCCGTGTATTACTGTGCGA GAGATCTCCTGGACCCCCAGCTAGATG ATGCTTTTGATATCTGGGGCCAAGGGA CAATGGTCACCGTCTCTTCAG | | ACTGTCAGCAGTATGGTAGCTCACCGTGG ACGTTCGGCCAAGGGACCAAGGTGGAAAT CAAAC | |
| C201 | M-C001 | GAAGTGCAGCTGGTGGAGTCTGGGGG AGGCTTGGTACAGCCTGGCAGGTCCC TGAGACTCTCCTGTGCAGCCTCTGGAT TCACCTTTGATGATTATGCCATGCACTG GGTCCGGCAAGCTCCAGGGAAGGGCC TGGAGTGGGTCTCAGGTATTAGTTGGA ATAGTGGTAGTATAGGCTATGCGGACT CTGTGAAGGGCCGATTCACCATCTCCA GAGACAACGCCAAGAACTCCCTGTATC TGCAAATGAACAGTCTGAGAGCTGAGG AC ACGGCCTTGTATTACTGTGTAAAAGGG GTCGAGTATAGCAGCTCGAGCAACTTT GACTACTGGGGCCAGGGAACCCTGGT CACCGTCTCCTCAG | 351 | CATCCGGATGACCCAGTCTCCATCTTCTGT GTCTGCATCTGTAGGAGACAGAGTCACCA TCACTTGTCGGGCGAGTCAGGGTATTAGC AGCTGGTTAGCCTGGTATCAGCAGAAACC AGGGAAAGCCCCTAAGCTCCTGATCTATG TTGAATCCAGTTTGCAAAGTGGGGTCCCA TCAAGGTTCAGCGGCAGTGGATCTGGGAC AGATTTCACTCTCACTATCAGCAGCCTGCA GCCTGAAGATTTTGCAACCTACTATTGTCA ACAGGCTAACAGTTTCCCTCTCACTTTCGG CGGAGGGACCAAGGTGGAAATCAAAC | 352 |
| C202 | M-C002 | GAGGTGCAGCTGGTGGAGTCTGGGGG AGGCTTGGTCCAGCCTGGGGGGTCCC TAAGACTCTCCTGTGCAGCCTCTGGAT TCACCGTCAGTAGCAACTACATGAGCT GGGTCCGCCAGGCTCCAGGGAAGGGG CTGGAGTGGGTCTCACTTATTTATAGC GGTGGTAGCACATACTACGCAGACTCC GTGAAGGGCCGATTCACCATCTCCAGA GACAATTCCAAGAACACGCTGTATCTT CAAATGAACAGCCTGAGAGCTGAGGAC ACGGCTGTGTATTACTGTGCGAGAGAT ACCCTTGGTAGGGGGGGCGACTACTG GGGCCAGGGAACCCTGGTCACCGTCT CCTCAG | 353 | GACATCCAGTTGACCCAGTCTCCATCCTC CCTGTCTGCATCTGTAGGAGACAGAGTCA CCATCACTTGCCAGGCGAGTCAGGACATT AGCAACTATTTAAATTGGTATCAGCAGAAA CCAGGGAAAGCCCCTAAGCTCCTGATCTA CGATGCATCCAATTTGGAAACAGGGGTCC CATCAAGGTTCAGTGGAAGTGGATCTGGG ACAGATTTTACTTTCACCATCAGCAGCCTG CAGCCTGAAGATATTGCAACATATTACTGT CAACAGTATGATAATCTCCCTCGGAGTTTT GGCCAGGGGACCAAGCTGGAGATCAAAC | 354 |
| C204 | M-C004 | GAGGTGCAGCTGTTGGAGTCTGGGGG AGGCTTGGAACAGCCTGGGGGGTCCC TGAGACTCTCCTGTGCAGCCTCTGGAT TCACTTTTAGCACCTATGCCATGAGCT GGGTCCGCCAGGCTCCAGGGAAGGGG CTGGAGTGGGTCTCAGCTATTAGTGGT AGTGGTGCTGGCACATTCTACGCAGAC TCCGTGAAGGGCCGGTTCACCATCTCC AGAGACAATTCCAAGAACACGCTGTAT CTGCAAATGAACAGCCTGAGAGCCGA GGACACGGCCGTATATTACTGTGCGAG AGAGAGCGATTGTGGTAGTACCAGCTG CTATCAAGTCGGGTGGTTCGACCCCTG GGGCCAGGGAACCCTGGTCACCGTCT CCTCAG | 355 | GACATCCAGTTGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCTCCGTGGAC GTTCGGCCAGGGGACCAAGGTGGAAATCA AAC | 356 |
| C205 | M-C005 | CAGGTGCAGCTGGTGCAGTCTGGGGC TGAGGTGAAGAAGCCTGGGGCCTCAG TGAAGGTTTCCTGCAAGGCATCTGGAC ACACCTTCACCAGCTACTATATGCACT GGGTGCGACAGGCCCCTGGACAAGGG CTTGAGTGGATGGGAATCATCAACCCT AGTGGTGGTAGCACAAGCTACGCACA GAAGTTCCAGGGCAGAGTCACCATGAC CAGGGACACGTCCACGAGCACAGTCT ACATGGAGCTGAGCAGCCTGAGATCTG AGGACACGGCTGTGTATTACTGTGCTA GGGGGCCGGAACGGGGTATAGTGGGA GCTACTGACTACTTTGACTACTGGGGC CAGGGAACCCTGGTCACCGTCTCCTCAG | 357 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCAGCAGCTACTTAGCCTGGTACCAGCA GAAACCTGGCCAGGCTCCCAGGCTCCTCA TCTATGGTGCATCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGTTAGCTCACCGTGG ACGTTCGGCCAAGGGACCAAGGTGGAGAT CAAAC | 358 |
| C207 | M-C007 | GAGGTGCAGCTGTTGGAGTCTGGGGG AGGCTTGGTACAGCCTGGGGGGTCCC TGAGACTCTCCTGTGCAGCCTCTGGAT TCACCTTTAGCAGCTATGCCATGAGCT GGGTCCGCCAGGCTCCAGGGAAGGGG CTGGAGTGGGTCTCAGCTATTAGTGGT | 359 | GAAATTGTGTTGACACAGTCTCCAGCCAC CCTGTCTTTGTCTCCAGGGGAAAGAGCCA CCCTCTCCTGCAGGGCCAGTCAGAGTGTT AGCAGCTACTTAGCCTGGTACCAACAGAA ACCTGGCCAGGCTCCCAGGCTCCTCATCT ATGATGCATCCAACAGGGCCACTGGCATC | 360 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | AGTGGTGGTAGCACATACTACGCAGAC TCCGTGAAGGGCCGGTTCACCATCTCC AGAGACAATTCCAAGAACACGCTGTAT CTGCAAATGAACAGCCTGAGAGCCGA GGACACGGCCGTATATTACTGTGCGAA AGAACCCATCGGCCAGCCACTGCTATG GTGGGACTACTGGGGCCAGGGAACCC TGGTCACCGTCTCCTCAG | | CCAGCCAGGTTCAGTGGCAGTGGGTCTG GGACAGACTTCACTCTCACCATCAGCAGC CTAGAGCCTGAAGATTTTGCAGTTTATTAC TGTCAGCAGCGTAGCAACTGGCCCCCGGG GGTTCGGCCAAGGGACCAAGGTGGAGAT CAAAC | |
| C208 | M-C008 | GAGGTGCAGCTGGTGCAGTCTGGAGC AGAGGTGAAAAAGCCCGGGGAGTCTC TGAAGATCTCCTGTAAGGGTTCTGGAT ACAGCTTTACCAGCTACTGGATCGGCT GGGTGCGCCAGATGCCCGGGAAAGGC CTGGAGTGGATGGGGATCATCTATCCT GGTGACTCTGATACCAGATACAGCCCG TCCTTCCAAGGCCAGGTCACCATCTCA GCCGACAAGTCCATCAGCACCGCCTAC CTGAAGTGGAGCAGCCTGAAGGCCTC GGACAGCGCCATGTATTACTGTGCGAG GGGGCCCAACCTCCAGAACTGGTTCG ACCCCTGGGGCCAGGGAACCCTGGTC ACCGTCTCCTCAG | 361 | GAAATTGTGTTGACGCAGTCTCCAGGCAC CCTGTCTTTGTCTCCAGGGGAAAGAGCCA CCCTCTCCTGCAGGGCCAGTCAGAGTGTT AGCGGCAGCTACTTAGCCTGGTACCAGCA GAGACCTGGCCAGGCTCCCAGGCTCCTCA TCTATGGTGCTTCCAGCAGGGCCACTGGC ATCCCAGACAGGTTCAGTGGCAGTGGGTC TGGGACAGACTTCACTCTCACCATCAGCA GACTGGAGCCTGAAGATTTTGCAGTGTATT ACTGTCAGCAGTATGGTAGCTCGCTCACT TTCGGCGGGGGGACCAAGGTGGAGATCA AAC | 362 |
| C209 | M-C009 | CAGGTGCAGCTGGTGCAGTCTGGGGC TGAGGTGAAGAAGTCTGGGGCCTCAG TGAAGGTCTCCTGCAAGGCTTCTGGAT ACACCTTCACCAGTTATGATATCAACTG GGTGCGACAGGCCACTGGACAAGGGC TTGAGTGGATGGGATGGATGAACCCTA ACAGTGGTAACACAGGCTATGCACAGA AGTTCCAGGGCAGAGTCACCATGACCA GGAACACCTCCATAAGCACAGCCTACA TGGANCTGAGCAGCCTGANATCTGANG ANACGGCCGTGTATTACTGTGCGANAG GGTTCAGCCTGACTTGGTACTTCGATC TCTGGGGCCGTGGNNCCCTGGTCACC GNCTCCTCAG | 363 | TCCTATGAGCTGACACAGCCACCCTCGGT GTCAGTGGCCCCAGGAAAGACGGCCAGG ATTACCTGTGGGGGAAACAACATTGGAAG CAAAAGTGTGCACTGGTACCAGCAGAAGC CAGGCCATGCCCCTGTACTGGTCGTCTAT GATGATAGCGACCGGCCCTCAGGGATCCC TGAGCGATTCTCTGGCTCCAACTCTGGGA ACACGGCCACCCTGACCATCAGCAGGGTC GAAGCCGGGGATGAGGCCGACTATTACTG TCAGGTGTGGGATAGTACTGGTGGTCATC CCGATGGTGTTCGGCGGAGGGACCAA GCTGACCGTCCTAG | 364 |
| C210 | M-C010 | GAGGTGCAGCTGGTGGAGTCTGGAGG AGGCTTGATCCAGCCTGGGGGGTCCC TGAGACTCTCCTGTGCAGCCTCTGGGT TCACCGTCAGTAGCAACTACATGAGCT GGGTCCGCCAGGCTCCAGGGAAGGGG CTGGAGTGGGTCTCAGTTATTTATAGC GGTGGTAGTACATTCTACGCAGACTCC GTGAAGGGCCGATTCACCTTCTCCAGA GACAATTCCAAGAACACGCTGTATCTT CAAATGAACAGCCTGAGAGCCGAGGA CACGGCCGTGTATTACTGTGCGAGAGA TTTGATGGCCTACGGTATGGACGTCTG GGGCCAAGGGACCACGGTCACCGTCT CCTCAG | 365 | GACATCCAGTTGACCCAGTCTCCATCCTTC CTGTCTGCATCTGTAGGAGACAGAGTCAC CATCACTTGCCGGGCCAGTCAGGGCATTA GCAGTTATTTAGCCTGGTATCAGCAAAAAC CAGGGAAAGCCCCTAAGCTCCTGATCTAT GCTGCATCCACTTTGCAAAGTGGGGTCCC ATCAAGGTTCAGCGGCAGTGGATCTGGGA CAGAATTCACTCTCACAATCAGCAGCCTG CAGCCTGAAGATTTTGCAACTTATTACTGT CAACAGCTTAATAGTTACCCTCAGGGCACT TTCGGCGGAGGGACCAAGGTGGAAATCAA AC | 366 |
| C211 | M-C011 | GAGGTGCAGCTGGTGGAGTCTGGGGG AGGCTTGGTCCAGCCTGGGGGGTCCC TGAGACTCTCCTGTGCAGCCTCTGAAT TCACCGTCAGTAGCAACTACATGAGCT GGGTCCGCCAGGCTCCAGGGAAGGGG CTGGAGTGGGTCTCAGTTATTTATAGC GGTGGTAGCACATTCTACGCAGACTCC GTGAAGGGCCGATTCACCATCTCCAGA GACAATTCCAAGAACACGCTGTATCTT CAAATGAACAGCCTGAGACCTGAGGAC ACGGCTGTGTATTACTGTGCGAGAGAC TACGGTGACTTCTACTTTGACTTCTGG GGCCAGGGAACCCTGGTCACCGTCTC CTCAG | 367 | GAAATAGTGATGACGCAGTCTCCAGCCAC CCTGTCTGTGTCTCCAGGGGAAAGAGCCA CCCTCTCCTGCAGGGCCAGTCAGAGTGTT AGCAGCAACTTAGCCTGGTACCAGCAGAA ACCTGGCCAGGTCCCAGGCTCCTCATCT ATGGTGCATCCACCAGGGCCACTGGTATC CCAGCCAGGTTCAGTGGCAGTGGGTCTG GGACAGAGTTCACTCTCACCATCAGCAGC CTGCAGTCTGAAGATTTTGCAGTTTATTAC TGTCAGCAGTATAATAACTGGCCCCGGAC GTTCGGCCAAGGGACCAAGGTGGAGATCA AAC | 368 |
| C212 | M-C012 | CAGGTGCAGCTGGTGCAGTCTGGGGC TGAGGTGAAGAAGCCTGGGGCCTCAG TGAAGGTCTCCTGCAAGGCTTCTGGAT ACACCGTCACCGGCTATTATATACACT GGGTGCGACAGGCCCCTGGACAAGGG | 369 | CTGACTCAGCCTGCCTCCGTGTCTGGGTC TCCTGGACAGTCGATCACCATCTCCTGCA CTGGAACCAGCAGTGATGTTGGGAGTTAT AACCTTGTCTCCTGGTACCAACAGCACCC AGGCAAAGCCCCCAAACTCATGATTTATGA | 370 |

TABLE 5-continued

Representative nucleotide sequences of cloned recombinant antibodies

| Antibody ID | Old antibody ID | IGH VDJ (nt) | SEQ ID NO | IGL VJ (nt) | SEQ ID NO |
|---|---|---|---|---|---|
| | | CTTGAGTGGATGGGATGGATCAGCCCT AACAGTGGTGGCACAAACTATGCACAG AAGTTTCAGGGCTGGGTCACCATGACC AGGGACATGTCCATACCACAGCCTAC ATGGAGCTGAGTAGACTGAGATCTGAC GACACGGCCGTGTATTACTGTGCGAG GGAACGATATTTTGACTTGGGTGGTAT GGACGTCTGGGGCCAAGGGACCACGG TCACCGTCTCCTCAG | | GGACAGTAAGCGGCCCTCAGGGGTTTCTA ATCGCTTCTCTGGCTCCAAGTCTGGCAAC ACGGCCTCCCTGACAATCTCTGGGCTCCA GGCTGAGGACGAGGCTGATTATTACTGCT GCTCATATGCAGGTAGTAGCACTCGGCTA TTCGGCGGAGGGACCAAGCTGACCGTCCT AG | |
| C214 | M-C014 | CAGGTGCAGCTGGTGGAGTCTGGGGG AGGCGTGGTCCAGCCTGGGAGGTCCC TGAGACTCTCCTGTGCAGCGTCTGGAT TCACCTTCAGTAGCTATGGCATGCACT GGGTCCGCCAGGCTCCAGGCAAGGGG CTGGAGTGGGTGGCAGCTATATGGTAT GATGGAAGTAATAAACACTATGCAGAC TCCGTGAAGGGCCGATTCACCATCTCC AGAGACAATTCCAAGAACACGCTGTAT CTGCAAATGAACAGCCTGAGAGCCGA GGACACGGCTGTGTATTACTGTGCGAG AGATGTAGGGCGGGTGACGACCTGGT TCGACCCCTGGGGCCAGGGAACCCTG GTCACCGTCTCCTCAG | 371 | GACATCCAGTTGACCCAGTCTCCATCCTC CCTGTCTGCATCTGTAGGAGACAGAGTCA CCATCACTTGCCGGGCAAGTCAGAGCATT AGCAGCTATTTAACTTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCTCCGTGGAC GTTCGGCCAAGGGACCAAGGTGGAGATCA AAC | 372 |
| C215 | M-C015 | GAGGTGCAGCTGTTGGAGTCTGGGGG AGGCTTGGTACAGCCTGGGGGGTCCC TGAGACTCTCCTGTGCAGCCTCTGGAT TCACCTTTAGCAGCTATGCCATGAGCT GGGTCCGCCAGGCTCCAGGGAAGGGG CTGGAGTGGGTCTCAGCTATTACTGAT AGTGGTGATGGCACATTCTACGCAGAC TCCGTGAAGGGCCGGTTCACCATCTCC AGAGACAATTCCAAGAACACGCTGTAT CTGCAAATGAACAGCCTGAGAGCCGA GGACACGGCCGTTTATTACTGTGCGTC CGAAGAGGACTACAGTAACTACGTGGG GTGGTTCGACCCCTGGGGCCAGGGAA CCCTGGTCACCGTCTCCTCAG | 373 | GACATCCAGTTGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGCTCCTGATCTA TGCTGCATCCAGTTTGCAAAGTGGGGTCC CATCAAGGTTCAGTGGCAGTGGATCTGGG ACAGATTTCACTCTCACCATCAGCAGTCTA CAACCTGAAGATTTTGCAACTTACTACTGT CAACAGAGTTACAGTACCCCTCCGTGGAC GTTCGGCCAAGGGACCAAGGTGGAAATCA AAC | 374 |
| C216 | M-C016 | GAGGTGCAGCTGGTGGAGTCTGGGGG AGGCTTGGTACAGCCTGGGGGGTCCC TGAGACTCTCCTGTGCAGCCTCTGGAT TCACCTTCAGTAGCTACGACATGCACT GGGTCCGCCAAGCTACAGGAAAAGGT CTGGAGTGGGTCTCAGCTATTGGTACT GCTGGTGACACATACTATCCAGACTCC GTGAAGGGCCGATTCACCATCTCCAGA GAAAATGCCAAGAACTCCTTGTATCTTC AAATGAACAGCCTGAGAGCCGGGGAC ACGGCTGTGTATTACTGTGCAAGAGAT CGGGGAAGCAGTGGCTGGTACGGCTG GTACTTCGATCTCTGGGGCCGTGGCAC CCTGGTCACCGTCTCCTCAG | 375 | GACATCCAGTTGACCCAGTCTCCATCCTC CCTGTCTGCATCTGTAGGAGACAGAGTCA CCATCACTTGCCGGGCAAGTCAGAGCATT AGCAGCTATTTAAATTGGTATCAGCAGAAA CCAGGGAAAGCCCCTAAGCTCCTGATCTA TGTTGCATCCAGTTTGCAAAGTGGGGTCC CATCAAGGTTCAGTGGCAGTGGATCTGGG ACAGATTTCACTCTCACCATCAGCAGTCTG CAACCTGAAGATTTTGCAACTTACTACTGT CAACAGAGTTACAGTACCCCCCCGATCAC CTTCGGCCAAGGGACACGACTGGAGATTA AAC | 376 |

TABLE 6

Effective and inhibitory concentrations of the monoclonal antibodies

| Participant ID | Antibody ID | SARS-CoV-2 IC50 ng/ml | SARS-CoV-2 IC80 ng/ml | SARS-CoV-2 IC90 ng/ml | SARS-CoV IC50 ng/ml | SARS-CoV-2 RB EC50 ng/ml | SARS-CoV RBD EC50 ng/ml |
|---|---|---|---|---|---|---|---|
| COV21 | C002 | 8.88 | 21.95 | 37.61 | NT | 3.14 | >1000 |
| COV21 | C003 | 313.79 | 992.62 | >1000 | NT | 6.37 | >1000 |
| COV21 | C004 | 10.67 | 41.08 | 91.71 | NT | 2.39 | >1000 |
| COV21 | C005 | 60.49 | 130.65 | 205.20 | NT | 4.41 | >1000 |
| COV21 | C006 | 321.51 | >1000 | >1000 | NT | 1.81 | >1000 |
| COV21 | C008 | 625.46 | >1000 | >1000 | NT | 4.63 | >1000 |
| COV21 | C009 | 4.82 | 14.54 | 29.34 | NT | 1.80 | >1000 |

TABLE 6-continued

Effective and inhibitory concentrations of the monoclonal antibodies

| Participant ID | Antibody ID | SARS-CoV-2 IC50 ng/ml | SARS-CoV-2 IC80 ng/ml | SARS-CoV-2 IC90 ng/ml | SARS-CoV IC50 ng/ml | SARS-CoV-2 RB EC50 ng/ml | SARS-CoV RBD EC50 ng/ml |
|---|---|---|---|---|---|---|---|
| COV21 | C010 | >1000 | >1000 | >1000 | >1000 | 5.44 | >1000 |
| COV21 | C013 | 42.48 | 360.59 | >1000 | NT | 2.59 | >1000 |
| COV21 | C016 | >1000 | >1000 | >1000 | NT | 7.41 | >1000 |
| COV21 | C017 | 72.67 | 256.18 | 543.87 | NT | 1.63 | >1000 |
| COV21 | C018 | >1000 | >1000 | >1000 | NT | 1.53 | >1000 |
| COV21 | C019 | >1000 | >1000 | >1000 | NT | 11.85 | >1000 |
| COV21 | C021 | >1000 | >1000 | >1000 | NT | 1.25 | >1000 |
| COV21 | C022 | 73.57 | 314.71 | 736.87 | 168.15 | 2.40 | 5.99 |
| COV21 | C027 | >1000 | >1000 | >1000 | >1000 | 2.65 | 696.05 |
| COV21 | C029 | >1000 | >1000 | >1000 | NT | 4.13 | >1000 |
| COV21 | C030 | >1000 | >1000 | >1000 | >1000 | 2.89 | >1000 |
| COV21 | C031 | >1000 | >1000 | >1000 | NT | 22.69 | >1000 |
| COV57 | C032 | >1000 | >1000 | >1000 | NT | 99.31 | NT |
| COV57 | C036 | >1000 | >1000 | >1000 | NT | 64.10 | NT |
| COV57 | C037 | 155.78 | 488.45 | >1000 | NT | 1.93 | NT |
| COV57 | C038 | >1000 | >1000 | >1000 | NT | 4.69 | NT |
| COV57 | C040 | >1000 | >1000 | >1000 | NT | 11.10 | NT |
| COV107 | C101 | 8.20 | 30.15 | 65.30 | NT | 1.51 | >1000 |
| COV107 | C102 | 34.03 | 84.21 | 143.23 | NT | 4.54 | >1000 |
| COV107 | C103 | 4.38 | 12.58 | 23.59 | NT | 3.77 | >1000 |
| COV107 | C104 | 23.31 | 72.12 | 140.28 | NT | 8.31 | >1000 |
| COV107 | C105 | 26.09 | 72.24 | 133.70 | NT | 5.20 | >1000 |
| COV107 | C106 | >1000 | >1000 | >1000 | >1000 | 19.03 | 106.75 |
| COV107 | C107 | >1000 | >1000 | >1000 | NT | 11.55 | >1000 |
| COV107 | C108 | 480.69 | >1000 | >1000 | NT | 5.32 | >1000 |
| COV107 | C110 | 18.44 | 45.11 | 77.28 | NT | 7.29 | >1000 |
| COV107 | C112 | 111.79 | 701.99 | >1000 | NT | 3.38 | >1000 |
| COV107 | C113 | >1000 | >1000 | >1000 | NT | 6.93 | >1000 |
| COV107 | C114 | >1000 | >1000 | >1000 | NT | 9.51 | >1000 |
| COV107 | C115 | 198.33 | 958.18 | >1000 | NT | 3.40 | >1000 |
| COV107 | C116 | >1000 | >1000 | >1000 | NT | 37.56 | >1000 |
| COV107 | C117 | 348.00 | >1000 | >1000 | NT | 5.38 | >1000 |
| COV107 | C118 | 103.69 | 417.76 | >1000 | 138.36 | 3.45 | 3.82 |
| COV107 | C119 | 9.12 | 39.45 | 97.78 | NT | 3.57 | >1000 |
| COV107 | C120 | 13.26 | 26.73 | 40.30 | NT | 1.41 | >1000 |
| COV107 | C121 | 6.73 | 14.31 | 22.33 | NT | 2.85 | >1000 |
| COV107 | C122 | 22.80 | 57.77 | 100.12 | NT | 2.67 | >1000 |
| COV107 | C123 | 149.22 | 355.47 | 595.51 | NT | 1.92 | >1000 |
| COV107 | C124 | 341.82 | 937.26 | >1000 | NT | 2.23 | >1000 |
| COV107 | C125 | 43.32 | 92.54 | 144.26 | NT | 1.87 | >1000 |
| COV107 | C126 | >1000 | >1000 | >1000 | NT | 4.78 | >1000 |
| COV107 | C127 | 68.74 | 190.96 | 347.31 | NT | 2.62 | >1000 |
| COV072 | C128 | 101.22 | 263.35 | 460.73 | NT | 1.95 | >1000 |
| COV072 | C129 | 10.85 | 31.48 | 59.47 | NT | 1.16 | NT |
| COV072 | C130 | >1000 | >1000 | >1000 | NT | 2.05 | >1000 |
| COV072 | C131 | 30.52 | 178.90 | 759.11 | NT | 1.67 | >1000 |
| COV072 | C132 | 708.67 | >1000 | >1000 | NT | 2.92 | >1000 |
| COV072 | C133 | >1000 | >1000 | >1000 | NT | 1.98 | >1000 |
| COV072 | C134 | >1000 | >1000 | >1000 | NT | 1.57 | >1000 |
| COV072 | C135 | 16.61 | 32.81 | 48.90 | NT | 1.80 | >1000 |
| COV072 | C138 | >1000 | >1000 | >1000 | NT | 2.94 | >1000 |
| COV072 | C139 | >1000 | >1000 | >1000 | NT | 1.89 | >1000 |
| COV072 | C140 | 23.88 | 66.24 | 120.69 | NT | 2.19 | >1000 |
| COV072 | C141 | >1000 | >1000 | >1000 | >1000 | 1.71 | >1000 |
| COV047 | C143 | >1000 | >1000 | >1000 | NT | 3.66 | >1000 |
| COV047 | C144 | 6.91 | 17.28 | 29.66 | NT | 3.24 | >1000 |
| COV047 | C145 | 3.04 | 14.51 | 36.79 | NT | 3.86 | >1000 |
| COV047 | C146 | >1000 | >1000 | >1000 | NT | >1000 | >1000 |
| COV047 | C147 | >1000 | >1000 | >1000 | NT | >1000 | >1000 |
| COV047 | C148 | >1000 | >1000 | >1000 | NT | 64.69 | >1000 |
| COV047 | C149 | 45.42 | 139.99 | 271.02 | NT | 1.79 | NT |
| COV047 | C150 | >1000 | >1000 | >1000 | NT | 8.11 | >1000 |
| COV047 | C151 | 31.79 | 363.97 | >1000 | NT | 4.30 | >1000 |
| COV047 | C152 | 22.27 | 122.06 | 330.67 | NT | 1.88 | NT |
| COV047 | C153 | 70.71 | 490.08 | >1000 | NT | 3.17 | >1000 |
| COV047 | C154 | 435.50 | >1000 | >1000 | >1000 | 2.92 | 10.65 |
| COV047 | C155 | 11.00 | 35.75 | 77.01 | NT | 3.30 | >1000 |
| COV047 | C156 | >1000 | >1000 | >1000 | NT | 3.32 | >1000 |
| COV047 | C160 | >1000 | >1000 | >1000 | NT | 2.54 | NT |
| COV107 | C161 | 42.32 | 232.17 | 581.63 | NT | 1.63 | NT |
| COV107 | C162 | 14.44 | 59.81 | 138.75 | NT | 1.18 | NT |
| COV107 | C163 | 9.65 | 29.45 | 57.97 | NT | 1.77 | NT |
| COV047 | C164 | 239.15 | 865.40 | >1000 | NT | 2.06 | >1000 |

TABLE 6-continued

Effective and inhibitory concentrations of the monoclonal antibodies

| Participant ID | Antibody ID | SARS-CoV-2 IC50 ng/ml | SARS-CoV-2 IC80 ng/ml | SARS-CoV-2 IC90 ng/ml | SARS-CoV IC50 ng/ml | SARS-CoV-2 RB EC50 ng/ml | SARS-CoV RBD EC50 ng/ml |
|---|---|---|---|---|---|---|---|
| COV072 | C165 | 40.81 | 138.66 | 297.38 | NT | 4.25 | >1000 |
| COV96 | C201 | >1000 | >1000 | >1000 | NT | 2.98 | >1000 |
| COV96 | C202 | >1000 | >1000 | >1000 | NT | 3.40 | >1000 |
| COV96 | C204 | >1000 | >1000 | >1000 | >1000 | 3.73 | 9.41 |
| COV96 | C205 | >1000 | >1000 | >1000 | NT | >1000 | >1000 |
| COV96 | C207 | 158.52 | 960.39 | >1000 | NT | 1.87 | >1000 |
| COV96 | C208 | >1000 | >1000 | >1000 | NT | >1000 | >1000 |
| COV96 | C209 | >1000 | >1000 | >1000 | NT | 3.79 | >1000 |
| COV96 | C210 | 50.73 | 155.24 | 298.90 | NT | 2.83 | >1000 |
| COV96 | C211 | 12.79 | 34.87 | 62.89 | NT | 2.82 | >1000 |
| COV96 | C212 | >1000 | >1000 | >1000 | NT | >1000 | >1000 |
| COV96 | C214 | >1000 | >1000 | >1000 | NT | 5.75 | >1000 |
| COV96 | C215 | >1000 | >1000 | >1000 | >1000 | 5.33 | 17.94 |
| COV96 | C216 | >1000 | >1000 | >1000 | NT | 9.53 | >1000 |

NT = not tested

TABLE 7

Anti-SARS-CoV-2 IgG antibodies from COV20

| SEQUENCE_ID | SEQ ID NOS aa | aa | SEQ ID NOS cdr3_aa | cdr3_aa |
|---|---|---|---|---|
| COVD20_P1_HC_B6-1369 | 377 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YYCTRDDSSWPHFFDNWGQGTLVTVSS | 378 | TRDDSS WPHFF DN |
| COVD20_P1_HC_D9-1369 | 381 | EVQLVESGGGLVQPGGSLRLSCAASGFNFSTH WMHWVRQAPGKGLVWVSRISSDGSRRAYAT SVKGRFTISRDNAKNTLYLQMDSLRDDDTAVY YCTRDDSSWPHFFDNWGQGTLVTVSS | 382 | TRDDSS WPHFF DN |
| COVD20_P1_HC_D12-1369 | 385 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YYCTRDDSSWPHFFDNWGQGTLVTVSS | 386 | TRDDSS WPHFF DN |
| COVD20_P1_HC_E3-1369 | 389 | EVQLVESGGGLVQPGGSLRLSCAASGFNFSTH WMHWVRQAPGKGLVWVSRISSDGSRRAYAT SVKGRFTISRDNAKNTLYLQMDSLRDDDTAVY YCTRDDSSWPHFFDNWGQGTLVTVSS | 390 | TRDDSS WPHFF DN |
| COVD20_P1_HC_G12-1369 | 393 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YYCTRDDSSWPHFFDNWGQGTLVTVSS | 394 | TRDDSS WPHFF DN |
| COVD20_P1_HC_H3-1369 | 397 | EVQLVESGGGLVQPGGSLRLSCAASGFNFSTH WMHWVRQAPGKGLVWVSRISSDGSRRAYAT SVKGRFTISRDNAKNTLYLQMDSLRDDDTAVY YCTRDDSSWPHFFDNWGQGTLVTVSS | 398 | TRDDSS WPHFF DN |
| COVD20_P1_HC_H6-1369 | 401 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YFCTRDDSSWPHFFDNWGQGTLVTVSS | 402 | TRDDSS WPHFF DN |
| COVD20_P1_HC_H7-1369 | 405 | EVQLVESGGGLVQPGGSLRLSCAASGFNFSTH WMHWVRQAPGKGLVWVSRINTDGSRRAYA TSVKGRFTISRDNAKNTVHLQMDSLRDEDTAV YFCTRDDSSWPHFFDNWGQGTLVTVSS | 406 | TRDDSS WPHFF DN |
| COVD20_P1_HC_H10-1369 | 409 | EVQLVESGGGLVQPGGSLRLSCAASGFNFSTH WMHWVRQAPGKGLVWVSRISSDGSRRAYAT SVKGRFTISRDNAKNTLYLQMDSLRDDDTAVY YCTRDDSSWPHFFDNWGQGTLVTVSS | 410 | TRDDSS WPHFF DN |

TABLE 7-continued

Anti-SARS-CoV-2 IgG antibodies from COV20

| COVID020_Plate2_HC_19-P1369 | 413 | EVQLVESGGGLVQPGGSLRLSCAASGFNFSTH WMHWVRQAPGKGLVWVSRINTDGSRRAYA TSVKGRFTISRDNAKNTVHLQMDSLRDEDTAV YFCTRDDSSWPHFFDNWGQGTLVTVSS | 414 | TRDDSS WPHFF DN |
|---|---|---|---|---|
| COVID020_Plate2_HC_24-P1369 | 417 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YYCTRDDSSWPHFFDNWGQGTLVTVSS | 418 | TRDDSS WPHFF DN |
| COVID020_Plate2_HC_36-P1369 | 421 | EVQLVESGGGLVQPGGSLRLSCAASGFNFSTH WMHWVRQAPGKGLVWVSRISSDGSRRAYAT SVKGRFTISRDNAKNTLYLQMDSLRDDDTAVY YCTRDDSSWPHFFDNWGQGTLVTVSS | 422 | TRDDSS WPHFF DN |
| COVID020_Plate2_HC_71-P1369 | 425 | EVQLVESGGGLVQPGGSLRLSCAASGFNFSTH WMHWVRQAPGKGLVWVSRINSDGSRRAYA TSVKGRFTISRDNAKNTLYLQMDSLRDEDTAV YFCTRDDSSWPHFFDNWGQGTLVTVSS | 426 | TRDDSS WPHFF DN |

HEAVY

| COVD20_P1_HC_F7-1369 | 429 | EVQLVESGGGLVQPGGSLRLSCAASGFTFSNY DMHWVRQVTGEGLEWVSAIGTAGDTYYPGS VKGRFTISRENAKNSVFLQMNSLRAGDTAVYY CARGRGHCSSISCLHSWFDSWGQGTLVTVSS | 430 | ARGRG HCSSIS CLHSW FDS |
|---|---|---|---|---|
| COVID020_Plate2_HC_48-P1369 | 433 | EVQLVESGGGLVQPGGSLRLSCAASGFTFSNY DMHWVRQATGEGLEWVSAIGTAGDTYYPGS VKGRFTISRENAKNSVFLQMNSLRAGDTAVYY CARGRGHCSSISCLHSWFDSWGQGTLVTVSS | 434 | ARGRG HCSSIS CLHSW FDS |
| COVID020_Plate2_HC_63-P1369 | 437 | EVQLVESGGGLIQPGGSLRLSCAASGFTFNNY DIHWVRQATGEGLEWVSAIGTAGDTYYPGSV KGRFTISRENAKNSVFLQMNSLRAGDTAVYYC ARGRGHCSSISCLHSWFDSWGQGTLVTVSS | 438 | ARGRG HCSSIS CLHSW FDS |
| COVID020_Plate2_HC_66-P1369 | 441 | EVQLVESGGGLVQPGGSLRLSCAASGFTFSNY DIHWVRQATGEGLEWVSAIGTAGDTYYPGSV KGRFTISRENAKNSVFLQMNSLRAGDTAVYYC ARGRGHCSSISCLHSWFDSWGQGTLVTVSS | 442 | ARGRG HCSSIS CLHSW FDS |
| COVD20_P1_HC_A5-1369 | 445 | EVQLVESGGGLVQPGRSLRLSCAASGFTFDDY AMHWVRQAPGKGLEWVSGISWNSGSIGYAD SVKGRFTISRDNAKNSLYLQMNSLRAEDTALYY CAKSGPYPWAVYYYGMDVWGQGTTVTVSS | 446 | AKSGPY PWAVY YYGMD V |
| COVD20_P1_HC_E10-1369 | 449 | EVQLVESGGGLVQPGRSLRLSCAASGFTFDDY AMHWVRQAPGKGLEWVSGISWNSGSIGYAD SVKGRFTISRDNAKNSLYLQMNSLRAEDTALYY CAKSGPYPWAVYYYGMDVWGQGTTVTVSS | 450 | AKSGPY PWAVY YYGMD V |
| COVID020_Plate2_HC_79-P1369 | 453 | EVQLVESGGGLVQPGRSLRLSCAASGFTFDDY AMHWVRQAPGKGLEWVSGISWNSGSIGYAD SVKGRFTISRDNAKNSLYLQMNSLRAEDTALYY CAKSGPYPWAVYYYGMDVWGQGTTVTVSS | 454 | AKSGPY PWAVY YYGMD V |
| COVD20_P1_HC_H8-1369 | 457 | QVQLVQSGAEVKKPGASVKVSCKASGYTFTGY YVHWVRQAPGQGLEWMGWINPNSGGTNYT QKFQGRVTMTRDRSISTAYMELSGLRSDDTAV YYCARDLTYGTVFYGMDVWGQGTTVTVSS | 458 | ARDLTY GTVFY GMDV |
| COVD20_P1_HC_B7-1369 | 461 | QVQLVESGGGLVKPGGSLRLSCAASGFTFSDY YMSWIRQAPGKGLEWVSSISSSGSTIYYADSVK GRFTISRDNAKTSLYLQMNSLRAEDTAVYYCA RGKWLRGSFDYWGQGTLVTVSS | 462 | ARGKW LRGSFD Y |
| COVID020_Plate2_HC_33-P1369 | 3186 | QVQLVESGGGLVKPGGSLRLSCAASGFTFSDY YMSWIRQAPGKGLEWVSYISSSSPYTNYADSV KGRFTISRDNAKNSLYLQMNSLRAEDTAVYYC ARGPSSTHESRPRPFDYWGQGTLVTVSS | 466 | ARGPSS THESRP RPFDY |
| COVID020_Plate2_HC_23-P1369 | 3187 | EVQLVESGGGLVKPGGSLRVSCAASGFTFTNA WMSWVRQAPGKGLEWVGRIKSKTDGGTTDY AAPVKGRFTISRDDSKNTLYLQMNSLKTEDTA VYYCTTSRGGDWPVTDYWGQGTLVTVSS | 470 | TTSRG GDWP VTDY |

TABLE 7-continued

Anti-SARS-CoV-2 IgG antibodies from COV20

| SEQUENCE_ID | SEQ ID NOS aa | aa | SEQ ID NOS cdr3_aa | cdr3_aa |
|---|---|---|---|---|
| COVID020_Plate2_HC_41-P1369 | 469 | EVQLLESGGGLVQPGGSLRLSCAASGFTFSSYA MSWVRQAPGKGLEWVSVISGSGGSTYYADSV KGRFTISRDNFKNTLYLQMNSLRAEDTAVYYC AKDLEYYDSSGYPRPSEYFQHWGQGTLVTVSS | 474 | AKDLEY YDSSGY PRPSEY FQH |
| COVID020_Plate2_HC_16-P1369 | 3188 | EVQLLESGGGLVQPGGSLRLSCAASGFTFSSYA MSWVRQAPGKGLEWVSGISGSGGSTYYADSV KGRFTISRDNSKNTLYLQMNSLRAEDTAVYYC AKGGPDYYDSSGYIRSKPEYFQHWGQGTLVTV SS | 478 | AKGGP DYYDSS GYIRSK PEYFQ H |
| COVID020_Plate2_HC_64-P1369 | 473 | QVQLVESGGGVVQPGRSLRLSCAASGFTFSSY GMHWVRQAPGKGLEWVAVILYDGSNKYYAD SVKGRFTISRDNAKNTLYLQMNSLRAEDTAVY YCAKPTHPGPSSEYFQHWGQGTLVTVSS | 482 | AKPTH PGPSSE YFQH |
| COVD20_P1_HC_E1-1369 | 477 | QVQLVESGGGVVQPGRSLRLSCAASGFTFSSY GMHWVRQAPGKGLEWVAVISYDGSNKYYAD SVKGRFTISRDNSKNTLYLQMNSLRAEDTAVYY CAKPTHPGPSSEYFQHWGQGTLVTVSS | 486 | AKPTH PGPSSE YFQH |
| COVD20_P1_HC_H5-1369 | 481 | QVQLVESGGGVVQPGRSLRLSCAASGFTFSSY GMHWVRQAPGKGLEWVAVISYDGSNKYYAD SVKGRFTISRDNSKNTLYLQMNSLRAEDTAVYY CAKKGGLYGDYLNWFDPWGQGTLVTVSS | 490 | AKKGG LYGDYL NWFDP |
| COVD20_P1_HC_G1-1369 | 485 | QLQLQESGSGLVKPSQTLSLTCAVXGGSISSGG YSWSWIRQPPGKGLEWIGYIYHSGSTYYNPSL KSRVTISVDRSKNQFSLKLSSVTAADTAVYYCA RGPPIEGWLRLGLGGGDWYFDLWGRGTLVTV SS | 3189 | ARGPPI EGWLR LGLGG GDWYF DL |
| COVID020_Plate2_HC_83-P1369 | 489 | EVQLVQSGAEVKKPGESLRISCKGSGYSFTSYW ISWVRQMPGKGLEWMGRIDPSDYYTNYSPSF QGHVTISADKSISTAYLQWSSLKASDTAMYYC ARHDEVDTAAGGYWGQGTLVTVSS | 3190 | ARHDE VDTAA GGY |

| SEQUENCE_ID | SEQ ID NOS aa | aa | SEQ ID NOS cdr3_aa | cdr3_aa |
|---|---|---|---|---|
| COVD20_P1_K_B6-1389 | 379 | DIQMTQSPSSLSAFVGDRVTITCRASQ SVANYLNWYQQKPGKAPKLLIYSASSL QSGVPSRFSGSGSGTDFSLTISSLQPED TATYYCQQSFITPWTFGQGTKVEIK | 380 | QQ SFIT PW T |
| COVD20_P1_K_D9-1389 | 383 | DIQMTQSPSSLSAFVGDRVTITCRASQ SVANYLNWYQQKPGKAPKLLIYSASSL QSGVPSRFSGGGSGTDFSLTISSLQPED TATYYCQQSFITPWTFGQGTKVEIK | 384 | QQ SFIT PW T |
| COVD20_P1_K_D12-1389 | 387 | DIQMTQSPSSLSAFVGDRVTITCRASQ SVANYLNWYQQKPGKAPKLLIYSASSL QSGVPSRFSGSGSGTDFSLTISSLQPED TATYYCQQSFITPWTFGQGTKVEIK | 388 | QQ SFIT PW T |
| COVD20_P1_K_E3-1389 | 391 | DIQMTQSPSSLSAFVGDRVTITCRASQ SVANYLNWYQQKPGKAPKLLIYSASSL QSGVPSRFSGGGSGTDFSLTISSLQPED TATYYCQQSFITPWTFGQGTKVEIK | 392 | QQ SFIT PW T |
| COVD20_P1_K_G12-1389 | 395 | DIQMTQSPSSLSAFVGDRVTITCRASQ SVANYLNWYQQKPGKAPKLLIYSASSL QSGVPSRFSGSGSGTDFSLTISSLQPED TATYYCQQSFITPWTFGQGTKVEIK | 396 | QQ SFIT PW T |
| COVD20_P1_K_H3-1389 | 399 | DIQMTQSPSSLSAFVGDRVTITCRASQ SVANYLNWYQQKPGKAPKLLIYSASSL QSGVPSRFSGGGSGTDFSLTISSLQPED TATYYCQQSFITPWTFGQGTKVEIK | 400 | QQ SFIT PW T |
| COVD20_P1_K_H6-1389 | 403 | DIQMTQSPSSLSASVGDRVTITCRASQ SVANYLNWYQQKPGKAPKLLIYSASSL QSGVPSRFSGSGSGTDFSLTISSLQPED TATYYCQQSFITPWTFGQGTKVEIK | 404 | QQ SFIT PW T |

TABLE 7-continued

Anti-SARS-CoV-2 IgG antibodies from COV20

| | | | | |
|---|---|---|---|---|
| COVD20_P1_K_H7-1389 | 407 | DIQMTQSPSSLSASVGDRVTITCRASQ SVANYLNWYQQKPGKAPKLLIYSASSL QSGVPSRFSGSGSGTDFSLTISSLQPED TATYYCQQSFITPWTFGQGTKVEIK | 408 | QQ SFIT PW T |
| COVD20_P1_K_H10-1389 | 411 | DIQMTQSPSSLSAFVGDRVTITCRASQ SVANYLNWYQQKPGKAPKLLIYSASSL QSGVPSRFSGGGSGTDFSLTISSLQPED TATYYCQQSFITPWTFGQGTKVEIK | 412 | QQ SFIT PW T |
| COVID020_Plate2_Kappa_19-P1389 | 415 | DIQMTQSPSSLSASVGDRVTITCRASQ SVANYLNWYQQKPGKAPKLLIYSASSL QSGVPSRFSGSGSGTDFSLTISSLQPED TATYYCQQSFITPWTFGQGTKVEIK | 416 | QQ SFIT PW T |
| COVID020_Plate2_Kappa_24-P1389 | 419 | DIQMTQSPSSLSASVGDRVTITCRASQ SVANYLNWYQKKPGKAPKLLIYSASSL QSGVPSRFSGSGSGTDFSLTISSLQPED TATYYCQQSFITPWTFGQGTKVEIK | 420 | QQ SFIT PW T |
| COVID020_Plate2_Kappa_36-P1389 | 423 | DIQMTQSPSSLSAFVGDRVTITCRASQ SVANYLNWYQQKPGKAPKLLIYSASSL QSGVPSRFSGGGSGTDFSLTISSLQPED TATYYCQQSFITPWTFGQGTKVEIK | 424 | QQ SFIT PW T |
| COVID020_Plate2_Kappa_71-P1389 | 427 | DIQMTQSPSSLSASVGDRVTITCRASQ SVANYLNWYQQKPGKAPKLLIYSASSL QSGVPSRFSGSGSGTDFSLTISSLQPED TATYYCQQSFITPWTFGQGTKVEIK | 428 | QQ SFIT PW T |
| LAMBDA | | | | |
| COVD20_P1_L_F7-1409 | 431 | QSVLTQPPSVSGAPGQRVTISCTGSSS NIGAGSDVHWYQKLPGIAPKVLIYGYS NRPSGVPDRFSGSKSGTSASLAITGLQA EDEADYYCQSYDTSLRVVFGGGTKLTV | 432 | QSY DTS LRV V |
| COVID020_Plate2_Lambda_48-P1409 | 435 | QSVLTQPPSVSGAPGQRVTISCTGSSS NIGAGSDVHWYQKLPGTAPKVLIYGYS NRPSGVPDRFSGSKSGTSASLAITGLQA EDEADYYCQSYDTSLRVVFGGGTKLTV | 436 | QSY DTS LRV V |
| COVID020_Plate2_Lambda_63-P1409 | 439 | QSVLTQPPSVSGAPGQRVTISCTGSSS NIGAGSDVHWYQKLPGTAPKVLIYGYS NRPSGVPDRFSGSKSGTSASLAITGLQA EDEADYYCQSYDTSLRVVFGGGTKLTV | 440 | QSY DTS LRV V |
| COVID020_Plate2_Lambda_66-P1409 | 443 | QSVLTQPPSVSGAPGQRVTISCTGSSS NIGAGSDVHWYQKLPGTAPKVLIYGY NNRPSGVPDRFSGSKSGTSASLAITGL QAEDEADYYCQSYDTSLRVVFGGGTKL TV | 444 | QSY DTS LRV V |
| COVD20_P1_L_A5-1409 | 447 | QSALTQPASVSGSPGQSITISCTGTSSD VGGYNYVSWYQQHPGKAPKLMIYEVS NRPSGVSNRFSGSKSGNTASLTISGLQ AEDEADYYCSSYTSSSTVFGGGTKLTVL | 448 | SSY TSS STV |
| COVD20_P1_L_E10-1409 | 451 | QSALTQPASVSGSPGQSITISCTGTSSD VGGYNYVSWYQQHPGKAPKLMIYEVS NRPSGVSNRFSGSKSGNTASLTISGLQ AEDEADYYCSSYTSSSTVFGGGTKLTVL | 452 | SSY TSS STV |
| COVID020_Plate2_Lambda_79-P1409 | 455 | QSALTQPASVSGSPGQSITISCTGTSSD VGGYNYVSWYQQHPGKAPKLMIYEVS NRPSGVSNRFSGSKSGNTASLTISGLQ AEDEADYYCSSYTSSSTVFGGGTKLTVL | 456 | SSY TSS STV |
| COVD20_P1_L_H8-1409 | 459 | QSVLTQPPSVSGAPGQRVTISCTGSSS NIGAGSDVHWYQKLPGTAPKVLIYGYS NRPSGVPDRFSGSKSGTSASLAITGLQA EDEADYYCQSYDTSLRVVFGGXQAG PS | 460 | QSY DTS LRV V |

TABLE 7-continued

Anti-SARS-CoV-2 IgG antibodies from COV20

KAPPA

| | | | | |
|---|---|---|---|---|
| COVD20_P1_K_B7-1389 | 463 | EIVLTQSPATLSLSPGERATLSCRASQSV SSYLAWYQQKPGQAPRLLIYDASNRAT GIPARFSGSGSGTDFTLTISSLEPEDFAV YYCQQRSNGFGGGTKVEIK | 464 | QQ RSN G |
| COVID020_Plate2_Kappa_33-P1389 | 467 | DIMTQSPSTLSASVGDRVTITCRASQ SISSWLAWYQQKPGKAPKLLIYKASSLE SGVPSRFSGSGSGTEFTLTISSLQPDDF ATYYCQQYNSYSPGIFTFGQGTRLEIK | 468 | QQ YNS YSP GIF T |

LAMBDA

| | | | | |
|---|---|---|---|---|
| COVID020_Plate2_Lambda_23-P1409 | 471 | QSVLTQPPSVSEAPRQRVTISCSGSSSN IGNNAVNWYQQLPGKAPKLLIYYDDLL PSGVSDRFSGSKSGTSASLAISGLQSED EADYYCAAWDDSLNVWVFGGGTKLT VL | 472 | AA WD DSL NV WV |
| COVID020_Plate2_Lambda_41-P1409 | 475 | QSVLTQPPSVSGAPGQRVTISCTGSSS NIGAGYDVHWYQQLPGTAPKLLIYGN SNRPSGVPDRFSGSKSGTSASLAITGLQ AEDEADYYCQSYDSSLSGYVFGTGTKV TVL | 476 | QSY DSS LSG YV |
| COVID020_Plate2_Lambda_16-P1409 | 479 | QSVLTQPPSVSGAPGQRVTISCTGSSS NIGAGYDVHWYQQLPGTAPKLLIYGN SNRPSGVPDRFSGSKSGTSASLAITGLQ AEDEADYYCQSYDSSLSVVFGGGTKLT VL | 480 | QSY DSS LSV V |

KAPPA

| | | | | |
|---|---|---|---|---|
| COVID020_Plate2_Kappa_64-P1389 | 483 | AIQLTQSPSSLSASVGDRVTITCRASQG ISSALAWYQQKPGKAPKLLIYDASSLES GVPSRFSGSGSGTDFTLTISSLQPEDFA TYYCQQFNSYPLTFGGGTKVEIK | 484 | QQ FNS YPL T |
| COVD20_P1_K_E1-1389 | 487 | AIQLTQSPSSLSAFVGDRVTITCRASQG ISSALAWYQQKPGKAPKLLIYDASSLES GVPSRFSGSGSGTDFTLTISSLQPEDFA TYYCQQFNYYPLTFGGGTKVEIK | 488 | QQ FNY YPL T |
| COVD20_P1_K_H5-1389 | 491 | DIQMTQSPSSLSASVGDRVTITCQASQ DISNYLNWYQQKPGKAPKLLIYDASNL ETGVPSRFSGSGSGTDFTFTISSLQPEDI ATYYCQQYDNLPLTFGGGTKVEIK | 492 | QQ YD NLP LT |

LAMBDA

| | | | | |
|---|---|---|---|---|
| COVD20_P1_L_G1-1409 | 495 | QSALTQPASVSGSPGQSITISCTGTSSD VGGYNYVSWYQQHPGKAPKLMIYDV SNRPSGVSNRFSGSKSGNTASLTISGLQ AEDEADYYCSSYTSSSTVVFGGGTKLTV L | 496 | SSY TSS STV V |
| COVID020_Plate2_Lambda_83-P1409 | 499 | QSALTQPASVSGSPGQSITISCTGTSSD VGGYNYVSWYQQHPGKAPKLMIYEVS NRPSGVSNRFSGSKSGNTASLTISGLQ AEDEADYYCSSYTSSSSYVFGTGTKVTV L | 500 | SSY TSS SSY V |

TABLE 8

| | | | | |
|---|---|---|---|---|
| \multicolumn{5}{|c|}{Anti-SARS-CoV-2 IgG antibodies from COV21} |
| SEQUENCE_ID | SEQ ID NOS | aa | SEQ ID NOS | cdr3_aa |
| \multicolumn{5}{|c|}{HEAVY} |
| COVD21_P2_HC_A4-p1369 | 501 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 502 | AKEGRPSDIVVVVAFDY |
| COVD21_P2_HC_B5-p1369 | 505 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 506 | AKEGRPSDIVVVVAFDY |
| COVD21_P2_HC_C12-p1369 | 509 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 510 | AKEGRPSDIVVVVAFDY |
| COVD21_P2_HC_E4-p1369 | 513 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 514 | AKEGRPSDIVVVVAFDY |
| COVD21_P2_HC_F1-p1369 | 517 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 518 | AKEGRPSDIVVVVAFDY |
| COVD21_P1_HC_B7-p1369 | 521 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 522 | AKEGRPSDIVVVVAFDY |
| COVD21_P1_HC_B9-p1369 | 525 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 526 | AKEGRPSDIVVVVAFDY |
| COVD21_P1_HC_E1-p1369 | 529 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 530 | AKEGRPSDIVVVVAFDY |
| COVD21_P1_HC_E11-p1369 | 533 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 534 | AKEGRPSDIVVVVAFDY |
| COVD21_P1_HC_F6-p1369 | 537 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 538 | AKEGRPSDIVVVVAFDY |
| COVD21_P3_HC_A6-p1369 | 541 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 542 | AKEGRPSDIVVVVAFDY |
| COVD21_P3_HC_B12-p1369 | 545 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 546 | AKEGRPSDIVVVVAFDY |
| COVD21_P3_HC_B12-p1369 | 549 | QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS | 550 | AKEGRPSDIVVVVAFDY |
| COVD21_P2_HC_C8-p1369 | 553 | QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS | 554 | ASPASRGYSGYDHGYYYYMDV |

TABLE 8-continued

Anti-SARS-CoV-2 IgG antibodies from COV21

| Name | SEQ ID NO | Heavy Chain Variable Region | SEQ ID NO | CDR3 |
|---|---|---|---|---|
| COVD21_P2_HC_F12-p1369 | 557 | QVQLVQSGAEVKKPGASVKVSCKASGYTFTGYYMHWVRQAPGQGLEWMGWINPISGGTNYAQKFQGRVTMTRDTSISTAYMELSRLSDDTAVYYCASPASRGYSGYDHGYYYYMDVWGKGTTVTVSS | 558 | ASPASRGYSGYDHGYYYYMDV |
| COVD21_P1_HC_H9-p1369 | 561 | QVQLVQSGAEVKKPGASVKVSCKASGYTFTGYYMHWVRQAPGQGLEWMGWINPISGGTNYAQKFQGRVTMTRDTSISTAYMELSRLSDDTAVYYCASPASRGYSGYDHGYYYYMDVWGKGTTVTVSS | 562 | ASPASRGYSGYDHGYYYYMDV |
| COVD21_P1_HC_E5-p1369 | 565 | QVQLVESGGGLVKPGGSLRLSCAASGFIFSDYCMSWIRRAPGKGLEWLSYISNSGTTRYYADSVKGRFTISRDNGRNSLYLQMDSLSAEDTAVYYCARRGDGSSSIYYYNYMDVWGKGTTVTVSS | 566 | ARRGDGSSSIYYYNYMDV |
| COVD21_P1_HC_F8-p1369 | 569 | QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS | 570 | ARRGDGSSSIYYYNYMDV |
| COVD21_P1_HC_G5-p1369 | 573 | QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS | 574 | ARRGDGSSSIYYYNYMDV |
| COVD21_P2_HC_A11-p1369 | 577 | QVQLVESGGGVVQPGRSLRLSCAASGFTYSGYAMHWVRQAPGKGLEWVAVILDDGSNKYYADSVKGRFTISRDNSKNTLYLQMNSLRAEDTAVYYCARDGIVDTAMVTWFDYWGQGTLVTVSS | 578 | ARDGIVDTAMVTWFDY |
| COVD21_P2_HC_D1-p1369 | 581 | QVQLVESGGGVVQPGRSLRLSCAASGFTFSSYAMHWVRQAPGKGLEWVAVILYDSNKYYADSVKGRFTISRDNSKNTLYLQMNSLRAEDTAVYYCARDQGMATTYFDYWGQGTLVTVSS | 582 | ARDQGMATTYFDY |
| COVD21_P2_HC_H7-p1369 | 585 | QVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS | 586 | ARDGIVDTALVTWFDY |
| COVD21_P1_HC_B5-p1369 | 589 | QVQLVQSGAEVKKPGASVKVSCKASGYTFTGYYMHWVRQAPGQGLEWMGWINPNSGGTNYAQKFQGRVTMTRDTSISTAYMELSRLSDDTAVYYCARDSPFSGLGASNDYWGQGTLVTVSS | 590 | ARDSPFSGLGASNDY |
| COVD21_P3_HC_B5-p1369 | 593 | QVQLVQSGAEVKKPGASVKVSCMASGYTFTGYYMHWVRQAPGQGLEWMGWINPNSGGTNYAQKFQGRVTMTRDTSISTAYMELSRLSDDTAVYYCARDSPFSALGASNDYWGQGTLVTVSS | 594 | ARDSPFSALGASNDY |
| COVD21_P2_HC_F9-p1369 | 597 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS | 598 | AAPHCSGGSCLDAFDI |
| COVD21_P1_HC_F10-p1369 | 601 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCYDAFDIWGQGTMVTVSS | 602 | AAPHCSGGSCYDAFDI |
| COVD21_P2_HC_E9-p1369 | 605 | EVQLVESGGDLVKPGGSLRLSCAASGFTFNNAWMSWVRQAPGKGLEWVGRIKDKSDGETTDYAAPVQGRFTVSRDDSKNTLYLQMNSLKTEDTAVYYCTTGPHYDSSGYSYTVDSWGQGTLVTVSS | 606 | TTGPHYDSSGYSYTVDS |
| COVD21_P2_HC_G2-p1369 | 609 | EVQLVESGGGLVKPGGSLRLSCAASGFTFSNAWMNWVRQAPGKGLEWVGRIKDKSDGGTIDYAAPVQGRFTISRDDSKNTLYLQMNSLKTEDTAVYYCTTGPHYDDSGYSYTVDYWGQGTLVTVSS | 610 | TTGPHYDDSGYSYTVDY |
| COVD21_P2_HC_G4-p1369 | 613 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGDCYSYYFDYWGQGTLVTVSS | 614 | AKASGIYCSGGDCYSYYFDY |

TABLE 8-continued

Anti-SARS-CoV-2 IgG antibodies from COV21

| Name | SEQ ID | VH Sequence | SEQ ID | CDRH3 |
|---|---|---|---|---|
| COVD21_P1_HC_B2-p1369 | 617 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGNCYSYYFDYWGQGTLVTVSS | 618 | AKASGIYCSGGNCYSYYFDY |
| COVD21_P2_HC_F2-p1369 | 621 | EVQLVESGGGLVQPGRSLRLSCAASGFTFDDYAMHWVRQAPGKGLEWVSGTSWNSGTIGYADSVKGRFTISRDNAKNSLYLQMNSLRAEDTALYYCAKGRVVYAIDPDSVSPFDYWGQGTLVTVSS | 622 | AKGRVVYAIDPDSVSPFDY |
| COVD21_P1_HC_E2-p1369 | 625 | EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKPRKRGDYYGSGSYDYWGQGTLVTVSS | 626 | AKPRKRGDYYGSGSYDY |
| COVD21_P2_HC_B10-p1369 | 629 | QLQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS | 630 | ARHAAAYYDRSGYYFIEYFQH |
| COVD21_P2_HC_H11-p1369 | 633 | QLQLQESGPGLVKPSETLSLTCTVSGGSISSSNYYWGWIRQPPGKGLEWIGSIYYSGSTYYNPSLKSRVTISVDTSKNQFSLKVSSVTAADTAVYYCARHAAAYYDRSGYYFIEYFQHWGXGTLVTVSS | 634 | ARHAAAYYDRSGYYFIEYFQH |
| COVD21_P3_HC_E4-p1369 | 637 | QVQLVQSGAEVKKPGASVKVSCKASGYTFTNYGISWVRQAPGQGLEWMGWNSAYNGNTNYAQKLQGRVTMTTDTSTSTAYMELRSLRSDDTAVYYCARTDGTPAEYFQYWGQGTLVTVSS | 638 | ARTDGTPAEYFQY |
| COVD21_P2_HC_G7-p1369 | 641 | QVQLVQSGAEVKKPGASVKVSCKASGYTFTGYYMHWVRQAPGQGLEWMGWINPNSGGTNYAQKFQGRVTMTRDTSISTAYMELSRLTSDDTAVYYCARGGQDELTGAFDIWGQGTMVTVSS | 642 | ARGGQDELTGAFDI |
| COVD21_P1_HC_D10-p1369 | 645 | QVQLVQSGAEVKKPGASVKVSCKASGYTFTGYYMHWVRQAPGQGLEWMGWINPISGGTNSAQKFQGRVTMTRDTSITTAYMELSSLRSDDTAVYHCAKSPYYYDSSGYLGGFDYWGQGTLVTVSS | 646 | AKSPYYYDSSGYLGGFDY |
| COVD21_P1_HC_C7-p1369 | 649 | QVQLVQSGAEVKKPGASVKVSCKASGYTFTGYYMHWVRQAPGQGLEWMGWINPNSGGRNYTQKFQGRVTMTRDTSISTAYMELSRLRSDDTAVYYCARDLGYSYVQGYFDYWGXGTLVTVSS | 650 | ARDLGYSYVQGYFDY |
| COVD21_P2_HC_B12-p1369 | 653 | QVQLVQSGAEVKKPGASVKVSCKASGYIFTGYYMHWVRQAPGQGLEWMGWINPNSGGTNYAQKFQGRVTMTRDTSISTVYMELSRLRSDDTAVYYCARDLGFSRLQFLFDYWGQGTLVTVSS | 654 | ARDLGFSRLQFLFDY |
| COVD21_P1_HC_F4-p1369 | 657 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCASTGYYILTGYEFGAMDVWGQGTTVTVSS | 658 | ASTGYYILTGYEFGAMDV |
| COVD21_P1_HC_D7-p1369 | 661 | QVQLVQSGAEVKKPGASVKVSCKASGYTFTDYYLHWVRQAPGQGLEWMGWINPTSGGTKYAQKFQGRVTMTRDTSITTAYMEVNRLRSDDTAVYYCARDRPLWFGVEYGMDVWGQGTTVTVSS | 662 | ARDRPLWFGVEYGMDV |
| COVD21_P1_HC_C1-p1369 | 665 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATTEGQQLPHPPYYYYYYYMDVWGKGTTVTVSS | 666 | ATTEGQQLPHPPYYYYYYMDV |
| COVD21_P2_HC_G5-p1369 | 669 | QVQLVQSGAEVKKPGASVKVSCKASGYTFTSYYMHWVRQAPGQGLEWIVIGIINPSGGSTTYAQKFQGRVTMTRDTSTSTVYMELSSLRSEDTAVYYCARDRAETEGSETYYYDSSGYYLLGYWGQGTLVTVSS | 670 | ARDRAETEGSETYYYDSSGYYLLGY |
| COVD21_P1_HC_D3-p1369 | 673 | QVQLVQSGAEVKKPGASVKVSCKASGYTFTSYYMHWVRQAPGQGLEWIVIGIINPSGGSTSYAQKFQGRVTMTRDTSTSTVYMELSSLRSEDTAVYYCARSSVTGTPPFDYWGQGTLVTVSS | 674 | ARSSVTGTPPFDY |

TABLE 8-continued

Anti-SARS-CoV-2 IgG antibodies from COV21

| | | | | |
|---|---|---|---|---|
| COVD21_P2_HC_G8-p1369 | 677 | QVQLVQSGAEVKKPGASVKVSCKASGYTFTSYY MHWVRQAPGQGLEWMGIINPSGGSTSYAQKF QGRVTMTRDTSTSTVYMELSSLRSEDTAVYYCA RVPREGTPGFDPWGQGTLVTVSS | 678 | ARVPREG TPGFDP |
| COVD21_P1_HC_E4-p1369 | 681 | QVQLVQSGAEVKKPGASVKVSCKAXGYTFTRX HMQWVGQAPGQGLEWMGIINXSGGSTSYAQ KFQGRVTMARDTSTSSVXMELSSLRXRTRPCIT VLVGISTIVVVRPAVWTSGAKGPRSPXX | 682 | LVGISTIV VVRPAV WTS |
| COVD21_P1_HC_F12-p1369 | 685 | QVQLVQSGAEVKKPGSSVKVSCKASGGTFSSYA ISWVRQAPGQGLEWMGGIIPIFGTANYAQKFQ GRVTITADESTSTAYMELSSLRSEDTAVYYCARV LYYYDSSGYPNLEYFQHWGQGTLVTVSS | 686 | ARVLYYY DSSGYPN LEYFQH |
| COVD21_P2_HC_B3-p1369 | 689 | QVQLVQSGAEVKKPGSSVKVSCKASGGTFSSYA ISWVRQAPGQGLEWMGGIIPIFGTANYAQKFQ GRVTITADESTSTAYMELSSLRSEDTAVYYCARG NRLLYCSSTSCYLDAVRQGYYYYYYMDVWGKG TTVTVSS | 690 | ARGNRLL YCSSTSCY LDAVRQG YYYYYYM DV |
| COVD21_P2_HC_B3-p1369 | 693 | QVQLVQSGAEVKKPGSSVKVSCKASGGTFSSYA ISWVRQAPGQGLEWMGGIIPIFGTANYAQKFQ GRVTITADESTSTAYMELSSLRSEDTAVYYCARG NRLLYCSSTSCYLDAVRQGYYYYYYMDVWGKG TTVTVSS | 694 | ARGNRLL YCSSTSCY LDAVRQG YYYYYYM DV |
| COVD21_P3_HC_C11-p1369 | 697 | QVQLVQSGAEVKKPGSSVKVSCKASGGTFSSYA ISWVRQAPGQGLEWMGGIIPIFGTANYAQKFQ GRVTITADKSTSTAYMELSSLRSEDTAVCYCARV GYYYDRSGFPRTEDYFDYWGQGTLVTVSS | 698 | ARVGYYY DRSGFPR TEDYFDY |
| COVD21_P1_HC_G6-p1369 | 701 | QVQLVQSGAEVKKPGSSVKVSCKASGGTFSSYA ISWVRQAPGQGLEWMGGIIPIFYTANYAQKFQ GRVTITADKSTSTAYMELSSLRSEDTAVYYCARD EGYCSGGSCYGYYYGMDVWGQGTTVTVSS | 702 | ARDEGYC SGGSCYG YYYGMD V |
| COVD21_P2_HC_B2-p1369 | 705 | QVQLVQSGAEVKKPGSSVKVSCKASGGTFSSYA ISWVRQAPGQGLEWMGGIIPIFGTANYAQKFQ GRVTITADESTSTAYMELSSLRSEDTAVYYCARG NRLLYCSSTSCYLDAVRQGYYYYYYMDVWGKG TTVTVSS | 706 | ARGNRLL YCSSTSCY LDAVRQG YYYYYYM DV |
| COVD21_P1_HC_D2-p1369 | 709 | QVQLVESGGGLVKPGGSLRLSCAASGFIFSDYY MSWIRQAPGKGLEWVSYISSSASTIYYADSVKG RFTISRDNAKNSLYLQMNSLRAEDTAVYYCARG LVYTPYRFGYWGQGTLVTVSS | 710 | ARGLVYT PYRFGY |
| COVD21_P3_HC_B4-p1369 | 713 | QVQLVESGGGLVKPGGSLRLSCAASGFTFIDYY MSWIRQAPGKGLEWVSYISSSGSTIYYADSVKG RFTISRDNAKNSLYLQMNSLRAEDTAVYYCARG RTWELVDYWGQGTLVTVSS | 714 | ARGRTW ELVDY |
| COVD21_P1_HC_A12-p1369 | 717 | QVQLVESGGGLVKPGGSLRLSCAASGFTFIDYY MSWIRQAPGKGLEWVSYISSSGSTIYYADSVKG RFTISRDNAKNSLYLQMNSLRAEDTAVYYCARG RTWELVDYWGQGTLVTVSS | 718 | ARGKWL RGSFDY |
| COVD21_P2_HC_A10-p1369 | 721 | EVQLVESGGGLVQPGGSLRLSCAASGFTFSSYD MHWVRQATGKGLEWVSAIGTAGDTYYPGSVK GRFTISRENAKNSLYLQMNSLRAGDTAVYYCAR VGYDSSGYSGWYFDLWGRGTLVTVSS | 722 | ARVGYDS SGYSGW YFDL |
| COVD21_P3_HC_A2-p1369 | 725 | EVQLVESGGGLVQPGGSLRLSCAASGFTFSSYD MHWVRQATGKGLEWVSAIGTAGDTYYPDSVK GRFTISRENAKNSLYLQMNSLRAGDTAVYYCAR GGGETITTVFDYWGQGTLVTVSS | 726 | ARGGGET ITTVFDY |
| COVD21_P2_HC_D3-p1369 | 729 | EVQLVESGGGLVQPGGSLRLSCAASGFTFSSYD MHWVRQATGKGLEWVSIIGTAGDTYYPGSVK GRFTISRENAKNSLYLQMNSLRAGDTAVYYCAR GSYSNYVGYMDVWGKGTTVTVSS | 730 | ARGSYSN YVGYMD V |
| COVD21_P2_HC_D10-p1369 | 733 | EVQLVESGGGLVKPGGSLRLSCAASGFTFSDAW MSWVRQAPGKGLEWVGRLKSKTDGGTTDYAA PVKGRFTISRDDSKNTLSLQMNSLKTEDTAVYYC TTDQIYGDYLRMPVPFDYWGQGTLVTVSS | 734 | TTDQIYG DYLRMPV PFDY |

TABLE 8-continued

Anti-SARS-CoV-2 IgG antibodies from COV21

| | | | | |
|---|---|---|---|---|
| COVD21_P3_HC_H6-p1369 | 737 | EVQLVESGGGLVKPGGSLRLSCAASGFTFSNAW MNWVRQAPGKGLEWIGRIKSNDGGTTDYAA PVQGRFTILRDDSKNTLYLQMTSLRTEDTAVYFC TTGPQYDDNGYSYTVDYWGRGTLVTVSS | 738 | TTGPQYD DNGYSYT VDY |
| COVD21_P3_HC_D12-p1369 | 741 | EVQLVESGGGLVKPGGSLRLSCAASGFTFSSYS MNWVRQAPGKGLEWVSSISSSSSYIYYADSVKG RFTISRDNAKNSLYLQMNSLRAEDTAVYYCARE VKRVVAAPEYYFDYWGQGXLVTVSS | 742 | AREVKRV VAAPEYY FDY |
| COVD21_P3_HC_D11-p1369 | 745 | EVQLVESGGGLVKPGGSLRLSCAASGFTFSSYS MNWVRQAPGKGLEWVSSISSSSSYIYYADSVKG RFTISRDNAKNSLYLQMNSLRAEDTAVYYCARE VKRVVAAPEYYFDYWGQGTLVTVSS | 746 | AREVKRV VAAPEYY FDY |
| COVD21_P2_HC_C3-p1369 | 749 | EVQLVESGGGLVKPGGSLRLSCAASGFTFSTYN MNWVRQAPGKGLEWVSSITSSSSYIYYADSVK GRFTISRDNAENSLYLQMNSLRAEDTAVYYCAR DRNRYDFWSGYYRLVGFDPWGQGTLVTVSS | 750 | ARDRNRY DFWSGYY RLVGFDP |
| COVD21_P1_HC_F11-p1369 | 753 | EVQLLESGGGLVQPGGSLRLSCAASGFTFSSYA MSWVRQAPGKGLEWVSGISDSGVSTYNADSV KGRFTISRDNSKNTLYLQMNSLRAEDTAVYYCA KVWSISLDAFDIWGQGTMVTVSS | 754 | AKVWSIS LDAFDI |
| COVD21_P2_HC_C4-p1369 | 757 | EVQLLESGGGLVQPGGSLRLSCAASGFTFNSYA MSWVRQAPGKGLEWVSGISGSGDSTYYADSV KGRFTISRDNSKNTVYLQMNSLRAEDTAVYYCA KDGGRQWLVELLDYWGHGTLVTVSS | 758 | AKDGGR QWLVELL DY |
| COVD21_P2_HC_G9-p1369 | 761 | EVQLLESGGGLVQPGGSLRLSCAASRFTFSNYA MSWVRQAPGKGLEWVSTISGSGGSTYYADSVK GRFTISRDNSKNTLYLQMNSLRAEDTAVYYCAK DRAAAHWATDYWGQGTLVTVSS | 762 | AKDRAAA HWATDY |
| COVD21_P1_HC_F7-p1369 | 765 | EVQLLESGGGLVQPGGSLRLSCAASGFTFSSYA MSWVRQAPGKGLEWVSAISGSGGSTYYADSV KGRFTISRDNSKNTLYLQMNSLRAEDTAVYYCA KDDSSGYHYYFDYWGQGTLVTVSS | 766 | AKDDSSG YHYYFDY |
| COVD21_P1_HC_D1-p1369 | 769 | EVQLLESGGGLVQPGGSLRLSCAASGFTFSSYA MSWVRQAPGKGLEWVSAISGSGDITYYADSVK GRFTISRDNSKNTLYLQMNSLRAEDTAVYYCAK DSGTAMVEIFDYWGQGTLVTVSS | 770 | AKDSGTA MVEIFDY |
| COVD21_P3_HC_E1-p1369 | 773 | EVQLLESGGDLVQPGGSLRLSCAASGFTFSSYA MSWVRQAPGKGLEWVSAISGSGGSTYYADSV KGRFTISRDNSKSTLYLQMNSLRAEDTAVYYCAK DLRSTTFYVYYFDYWGQGTLVTVSS | 774 | AKDLRST TFYVYYF DY |
| COVD21_P2_HC_F8-p1369 | 777 | EVQLLESGGGLVQPGGSLRLSCAASGFTFSSYA MSWVRQAPGKGLEWVSAISGSGGTTYYADSV KGRFTISRDNSKNTLYLQMNSLRAEDTAVYYCA KVPIHYCSNGVCYFDYWGQGTLVTVSS | 778 | AKVPIHY CSNGVCY FDY |
| COVD21_P3_HC_D4-p1369 | 781 | EVQLLESGGGLVQPGGSLRLSCAASGFTFSSYA MSWVRQAPGKGLEWVSAISGSGDSTYFADSVK GRFTISRDNSKNTLYLHMNSLRAEDTAVYYCAK VVGSGTPPDYYYYYYMDVWGKGTTVTVSS | 782 | AKVVGSG TPPDYYY YYYMDV |
| COVD21_P1_HC_D4-p1369 | 785 | QVQLVESGGGVVQPGRSLRLSCAASGFTFSNYG MHWVRQAPGKGLEWVAVISYDGSNKYFADSV KGRFTISRDNSKNTLYLQMNSLRAEDTAVYYCA RATCSGGSCLFGQNAFDIWGQGTMVTVSS | 786 | ARATCSG GSCLFGQ NAFDI |
| COVD21_P1_HC_G9-p1369 | 789 | QVQLVESGGGVVQPGRSLRLSCAASGFTFSSYG MHWVRQAPGKGLEWVAVISYDGSSKFYADSV KGRFTISRDNSKNTLYLQMNSLRAEDTAVYYCA RDYGSSWYQVPDYWGQGTLVTVSS | 790 | ARDYGSS WYQVPD Y |
| COVD21_P2_HC_H9-p1369 | 793 | QVQLVESGGGVVQPGRSLRLSCAASGFTFSSYG MHWVRQAPGKGLEWVTVISYDGRNKYYADSV KGRFTISRDNSKNTLYLQMNSLRAEDTAVYYCA REFGDPEWYFDYWGQGTLVTVSS | 794 | AREFGDP EWYFDY |

TABLE 8-continued

| Anti-SARS-CoV-2 IgG antibodies from COV21 | | | | |
|---|---|---|---|---|
| COVD21_P1_HC_G8-p1369 | 797 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNQNSYGYLSYFDYWGQGTLVTVSS | 798 | AKNQNSYGYLSYFDY |
| COVD21_P1_HC_E12-p1369 | 801 | QVQLVESGGGVVQPGRSLRLSCAASGFTFRRYGIHWVRQAPGKGLEWVAVISYDGSNKYYADSVKGRFTISRDNSKNTLYLQMNSLRAEDTAVYYCAKASGEYCGGGSCYRGVFDYWGQGTLVTVSS | 802 | AKASGEYCGGGSCYRGVFDY |
| COVD21_P3_HC_H4-p1369 | 805 | QVQLVESGGGVVQPGRSLRLSCATSGFTFSSYGLHWVRQAPGKGLEWVALISYDGSDKYYADSVKGRFTISRDTSKNTLFLQMNSLRAEDTAVYYCAKVMGPYCSGGSCYSGYFDYWGQGTLVTVSS | 806 | AKVMGPYCSGGSCYSGYFDY |
| COVD21_P1_HC_C4-p1369 | 809 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGGPYCSGGSCYSSYFDYWGQGTLVTVSS | 810 | AKAGGPYCSGGSCYSSYFDY |
| COVD21_P1_HC_G2-p1369 | 813 | QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCARDCGGDCYPTTDAFDIWGQGTMVTVSS | 814 | ARDCGGDCYPTTDAFDI |
| COVD21_P2_HC_H10-p1369 | 817 | QVQLVESGGGVVQPGRSLRLSCAASGFTFSSYAMHWVRQAPGKGLEWVAVISYDGSSKYYADSVKGRFTISRDNSKNTLYLQMNSLRAEDTAVYYCARDHDYGEIVDAFDIWGQGTMVTVSS | 818 | ARDHDYGEIVDAFDI |
| COVD21_P1_HC_B1-p1369 | 821 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSEDCSSTSCYLDYWGQGTLVTVSS | 822 | ARDSEDCSSTSCYLDY |
| COVD21_P3_HC_E6-p1369 | 825 | QVQLVESGGGVVQPGRSLRLSCAASGFTFSSYVMNWVRQAPGKGLAWVAVISFDGSNKYYADSVKGRFTVSRDNSKNTLYLQMNSLRAEDTALYYCARGPGWQWPELDYWGQGTLVTVSS | 826 | ARGPGWQWPELDY |
| COVD21_P3_HC_A5-p1369 | 829 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEDYYDSSGSFDYWGQGTLVTVSS | 830 | ATEDYYDSSGSFDY |
| COVD21_P3_HC_C12-p1369 | 833 | QVQLVESGGGVVQPERSLRLSCAASGFTFSSYAMHWVRQAPGKGLEWVAVISYDGSNKYYADSVKGRFTISRDNSKNTLYLQMNSLRAEDTAVYYCARSKSYTSWGYYHMDVW | 834 | ARSKSYTSWGYYHMDV |
| COVD21_P1_HC_D8-p1369 | 837 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDGTSITLITEGDAFDIWGQGTMVTVSS | 838 | ARDGTSITLITEGDAFDI |
| COVD21_P2_HC_B11-p1369 | 841 | QVQLVESGGGVVQPGRSLRLSCAASGFTFSSYGMHWVRQAPGKGLEWVAVIWHDGSNKYYADSVKGRFTISRDNSKNTLYLQMNSLRAEDTALYYCARDPSVWTAIDFDYWGQGTLVTVSS | 842 | ARDPSVVVTAIDFDY |
| COVD21_P2_HC_C9-p1369 | 845 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREHTPTDIVVVNVEYWGQGTLVTVSS | 846 | AREHTPTDIVVVNVEY |
| COVD21_P3_HC_H8-p1369 | 849 | QVQLVESGGGVVQPGRSLRLSCAASGFTFSSYCMHWVRQAPGKGLEWVAVIWYDGNNKYYADSVKGRFTISRDNSKNTLYLQMNSLRAEDTAVYYCAREKDIVATDFDYWGQGTLVTVSS | 850 | AREKDIVATDFDY |
| COVD21_P1_HC_E10-p1369 | 853 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCAREYFYDSSDYYFEYYFDYWGQGTLVTVSS | 854 | AREYFYDSSDYYFEYYFDY |

TABLE 8-continued

Anti-SARS-CoV-2 IgG antibodies from COV21

| | | | | |
|---|---|---|---|---|
| COVD21_P1_HC_A4-p1369 | 857 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDHSLGVRGDYGMDVWGQGTTVTVSS | 858 | ARDHSLGVRGDYGMDV |
| COVD21_P1_HC_G11-p1369 | 861 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGAVVRFLEWPTVGYYYYMDVWGKGTTVTVSS | 862 | ARDGAVVRFLEWPTVGYYYYYMDV |
| COVD21_P3_HC_G10-p1369 | 865 | QVQLVESGGGVVQPGRSLRLSCAASGFTFTSYGMHWVRQAPGKGLEWVAVIWYDGSNKYYADSVKGRFTISRDNSKNTLYLQMNSLRAEDTAVYYCARDMMIRGVAWYYYMDVWGKGTTVTVSS | 866 | ARDMMIRGVAWYYYMDV |
| COVD21_P2_HC_H2-p1369 | 869 | EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDSGGDIVVIPAVNGFDYWGQGTLVT | 870 | ARDSGGDIVVIPAVNGFDY |
| COVD21_P2_HC_A8-p1369 | 873 | EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREAHDGALTDYGDYLNWFDPWGQGTLVTVSS | 874 | AREAHDGALTDYGDYLNWFDP |
| COVD21_P1_HC_A3-p1369 | 877 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS | 878 | ARDLYSSGGTDI |
| COVD21_P3_HC_G1-p1369 | 881 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS | 882 | ARDLYSSGGTDI |
| COVD21_P1_HC_A2-p1369 | 885 | EVQLVESGGGLIQPGGSLRLSCAASGFTVSSNYMTWVRQAPGKGLEWVSLIYSGGSTFYADSVKGRFTISRDSSKNTLYLQMNSLRAEDTAVYYCARGYGDYYFDYWGQGTLVTVSS | 886 | ARGYGDYYFDY |
| COVD21_P2_HC_F7-p1369 | 889 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDFYFDYWGQGTLVTVSS | 890 | ARDYGDFYFDY |
| COVD21_P1_HC_C8-p1369 | 893 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGDYYFDYWGQGTLVTVSS | 894 | ARDWGDYYFDY |
| COVD21_P1_HC_A10-p1369 | 897 | EVQLVESGGGLIQPGGSLRLSCAASGFTVSSNYMSWVRQAPGKGLEWVSVIYSGGSTYYADSVKGRFTISRDNSKNTLYLQMNSLRAGDTAVYYCARDYGDFYFDYWGQGTLVTVSS | 898 | ARDYGDFYFDY |
| COVD21_P1_HC_B12-p1369 | 901 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLSVFGMDVWGQGTTVTVSS | 902 | ARDLSVFGMDV |
| COVD21_P3_HC_C9-p1369 | 905 | EVQLVESGGGLIQPGGSLRVSCAASGFTVSSNYMSWVRQAPGKGLEWVSVIYSGGSTYYADSVKGRFTISRDNSKNTLSLQMNSLRAEDTAVYYCARDLGERGMDVWGQGTTVTVSS | 906 | ARDLGERGMDV |
| COVD21_P1_HC_H7-p1369 | 909 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYCSGGSCHPPGQWLSDAFDIWGQGTMVTVSS | 910 | ARYCSGGSCHPPGQWLSDAFDI |
| COVD21_P1_HC_F1-p1369 | 913 | EVQLVESGGGLVQPGGSLRLSCAASGFTFSSYWMSWVRQAPGKGLEWVTNIKLDGSEKYYVDSVKGRFTISRDNAKNSLYLQMNSLRAEDTAVYYCARLRWLRADFDYWGQGTLVTVSS | 914 | ARLRWLRADFDY |

TABLE 8-continued

Anti-SARS-CoV-2 IgG antibodies from COV21

| | | | | |
|---|---|---|---|---|
| COVD21_P1_HC_C10-p1369 | 917 | EVQLVESGGGLVQPGGSLRLSCAASGFTFSSYW MSWVRQAPGKGLEWVANIKQDGSEKYYVDSV KGRFTISRDNAKNSLYLQMNSLRAEDTAVYYCA RYYDILTGYYVDYYYMDVWGXGTTVTVSS | 918 | ARYYDILT GYYVDYY YMDV |
| COVD21_P3_HC_H10-p1369 | 921 | EVQLVESGGGLVQPGGSLRLSCAASGFNFSTH WMHWVRQAPGKGLVWVSRINSDGSRRAYAT SVKGRFTISRDNAKNTLYLQMDSLRDEDTAVYY CTRDDSSWPHFFDNWGQGTLVTVSS | 922 | TRDDSS WPHFFD N |
| COVD21_P2_HC_D8-p1369 | 925 | EVQLVESGGGLVQPGGSLRLSCAASGFTFSSYW MHWVRQAPGKGLVWVSRINSDGSSTSYADSV KGRFTISRDNAKNTLYLQMNSLRAEDTAVYYCA RAWAMRQTTLTPEWIDYWGQGTLVTVSS | 926 | ARAWAM RQTTLTP EWIDY |
| COVD21_P2_HC_D9-p1369 | 929 | EVQLVESGGGLVQPGGSLRLSCAASGFTFSSYW MHWVRQAPGKGLVWVSRINSDGSSTSYADSV KGRFTISRDNAKNTLYLQMNSLRAEDTAVYYCA RAWAMRQTTLTPEWIDYWGQGTLVTVSS | 930 | ARAWAM RQTTLTP EWIDY |
| COVD21_P3_HC_G3-p1369 | 933 | EVQLVESGGGLVQPGRSLRLSCAASGFTFDDYA MHWVRQAPGKGLEWVSGVTWNSGSIGYADS VKGRFIISRDNAKNSLYLQMNSLRAEDTALYYCA KGGEGFRNWNDGLDYFDYWGQGTLVTVSS | 934 | AKGGEGF RNWNDG LDYFDY |
| COVD21_P1_HC_A5-p1369 | 937 | EVQLVESGGGLVQPGRSLRLSCAASGFTFDDYA MHWVRQAPGKGLEWVSGISWNSGTIGYADSV KGRFTISRDNAKNSLHLHMRSLRAEDTALYYCA KDGRSGDQWPELYYFDYWGQGTLVTVSS | 938 | AKDGRSG DQWPEL YYFDY |
| COVD21_P2_HC_E10-p1369 | 941 | EVQLVESGGGLVQPGRSLRLSCAASGFTFDDYA MHWVRQAPGKGLEWVSGISWNSGTIGYADSV KGRFTISRDNAKNSLYLQMNSLRAEDTAFYYCA KAGVRGIAAAGPDLNFDHWGQGTLVTVSS | 942 | AKAGVR GIAAAGP DLNFDH |
| COVD21_P3_HC_F9-p1369 | 945 | EVQLVESGGGLVQPGRSLRLSCAASGFTFDDYA MHWVRQAPGKGLEWVSGITWNSGSIAYADSV KGRFTISRDNAKNSLYLQMNSLRAEDTALYYCA KGSSSSYHNWFDPWGQGTLVTVSS | 946 | AKGSSSS YHNWFD P |
| COVD21_P1_HC_D6-p1369 | 949 | EVQLVESGGGLVQPGRSLRLSCAASGFTFDDYA MHWVRQAPGKGLEWVSGISWNSVSIDYADSV KGRFTISRDNAKNSLYLQMNSLRAEDTALYYCA KDGAGTENWFDPWGQGTLVTVSS | 950 | AKDGAG TENWFD P |
| COVD21_P2_HC_G3-p1369 | 953 | EVQLVESGGGLVQPGRSLRLSCAASGFTFDDYA MHWVRQAPGKGLEWVSGISWNSGSIGYAHSV KGRFTISRDNAKNSLYLHMNSLRAEDTALYYCA KDMLGNYYYYAMVVWGQGTTVTVSS | 954 | AKDMLG NYYYYAM VV |
| COVD21_P1_HC_E6-p1369 | 957 | QVQLQESGPGLVKPSQTLSLTCTVSGGSISSGGY YWSWIRQHPGKGLEWIGYIYYSGSTYYNPSLKS RVTISVDTSKNQFSLKLSSVTAADTAVYYCARTM YYYDSSGSFDYWGQGTLVTVSS | 958 | ARTMYYY DSSGSFD Y |
| COVD21_P1_HC_G1-p1369 | 961 | QVQLQESGPGLVKPSQTLSLTCTVSGGSISSGGY YWSWIRQHPGKGLEWIGYIYYSGSTYYNPSLES RVTISVDTSKNQFSLKLSSVTAADTAVYYCASGE LSAFGELFPHDYWGXGTLVTVSS | 962 | ASGELSA FGELFPH DY |
| COVD21_P3_HC_G7-p1369 | 965 | QVQLQESGPGLVKPSQTLSLTCTVSGGSISSGGY YWSWIRQHPGKGLEWIGYIYYSGSPYYNPSLKS RVTISIDTSKNQFSLKLSSVTAADTAVYYCARVH VVRGVANYPYFDYWGQGTLVTVSS | 966 | ARVHVVR GVANYPY FDY |
| COVD21_P1_HC_D5-p1369 | 969 | QVQLQESGPGLVKPSQTLSLTCTVSGGSISSGGY YWGWIRQHPGKGLEWIGYIYYSGSTYYNPSLKS RVTISVDTSKNQFSLKLSSVTAADTAVYYCARGS YSNYNGGLDYWGQGTLVTVSS | 970 | ARGSYSN YNGGLDY |
| COVD21_P2_HC_A9-p1369 | 973 | QVQLQESGPGLVKPSQTLSLTCTVSGGSFSSGG YYWHWIRQHPGKGLEWIGYIYYSGSTYYNPSLK SRVTISVDTSKNQFSLKLSSVTAADTAVYYCARV ATDYGDSFDYWGQGTLVTVSS | 974 | ARVATDY GDSFDY |

TABLE 8-continued

Anti-SARS-CoV-2 IgG antibodies from COV21

| SEQUENCE_ID | SEQ ID NOS | aa | SEQ ID NOS | cdr3_aa |
|---|---|---|---|---|
| COVD21_P3_HC_A8-p1369 | 977 | QVQLQESGPGLVKPSETLSLTCTVSGGSISSYYW SWIRQPAGKGLEWIGRIYTSGSTKYNPSLKSRVT MSVDTSKNQFSLKLSSVTAADTAVYYCARAPPG DFYDSSGYFSAFDIWGQGTMVTVSS | 978 | ARAPPGD FYDSSGY FSAFDI |
| COVD21_P1_HC_B6-p1369 | 981 | QVQLQESGPGLVKPSETLSLTCTVSGGSISAYYW SWIRQPAGKGLEWIGRIYTSGSTIYNPSLKSRVT MSVDTSKNQFSLKLSSVTAADTAVYYCARDNGY VWGSYRPDAFDIWGQGTMVTVSS | 982 | ARDNGY VWGSYR PDAFDI |
| COVD21_P1_HC_B6-p1369 | 985 | QVQLQESGPGLVKPSETLSLTCTVSGGSISAYYW SWIRQPAGKGLEWIGRIYTSGSTIYNPSLKSRVT MSVDTSKNQFSLKLSSVTAADTAVYYCARDNGY VWGSYRPDAFDIWGQGTMVTVSS | 986 | ARDNGY VWGSYR PDAFDI |
| COVD21_P2_HC_D4-p1369 | 989 | QVQLQESGPGLVKPSETLSLTCTVSGGSISSYYW SWIRQPAGKGLEWIGRIYTSGSTNYNPSLESRVT MSVDTSKNQFSLKLSSVTAADTAVYYCARVVGY SSRGANYYMDVWGKGTTVTVSS | 990 | ARVVGYS SRGANYY MDV |
| COVD21_P1_HC_H5-p1369 | 993 | QVQLQESGPGLVKPSETLSLTCTVSGGSISSYYW SWIRQPPGKGLEWIGYIYYSGSTNYNPSLKSRVT ISVDTSKNQFSLKLSSVTAADTAVYYCARVPSVG DCSSTSCLYWYFDLWGRGTLVTVSS | 994 | ARVPSVG DCSSTSCL YWYFDL |
| COVD21_P2_HC_F4-p1369 | 997 | QVQLQESGPGLVKPSETLSLTCTVSGGSISSYYW SWIRQPPGKGLEWIGYIYYSGSTNYNPSLKSRVT ISVDTSKNQFSLKLSSVTAADTAVYYCARYGMG ELLTLRSEYYFDYWGQGTLVTVSS | 998 | ARYGMG ELLTLRSE YYFDY |
| COVD21_P3_HC_C4-p1369 | 1001 | QVQLQESGPGLVKPSETLSLTCTVSGGSISSYYW SWIRQPPGKGLEWIGYIYYSGSTNYNPSLKSRVT ISVDTSKNQFSLKLSSVTAADTAVYYCARSYDSS GLSYNWFDPWGQGTLVTVSS | 1002 | ARSYDSS GLSYNWF DP |
| COVD21_P2_HC_E2-p1369 | 1005 | QVQLQESGPGLVKPSETLSLTCTVSGGSISSYYW SWIRQPPGKGLEWIGYIYYSGSTNYNPSLKSRVT ISVDTSKNQFSLKLSSVTAADTAVYYCARGGYYY DSSGYEYYYYYGMDVWGQGTTVTVSS | 1006 | ARGGYYY DSSGYEY YYYYGM DV |
| COVD21_P1_HC_C5-p1369 | 1009 | QVQLQESGPGLVKPSETLSLTCAVSGGSVSSGN YYWNWIRQPPGKGLEWIGYIYYSGSTNYNPSLK SRVTISVDTSKNQFSLKLNSVTAADTAVYHCARE TYYYDSSGYYISDAFDIWGQGTMVTVSS | 1010 | ARETYYY DSSGYYIS DAFDI |
| COVD21_P2_HC_H4-p1369 | 1013 | EVQLVQSGAEVKKPGESLKISCKGSGYSFSSYCIG WVRQMPGKGLEWMGIIYPGDSDTRYSPSFQG QVTISVDKSISTAYLQWSSLKASDTAMYYCARQ WRGYYDRSGYYHFDAFDIWGQGTMVTVSS | 1014 | ARQWRG YYDRSGY YHFDAFD I |
| COVD21_P1_HC_C6-p1369 | 1017 | EVQLVQSGAEVKKPGESLKISCKGSGYSFTTYCIG WVRQMPGKGLEWMGIIYPGDSDTRYSPSFQG QVTISADKSISTAYLQWSSLKASDTAMYYCARH WYYGDYGNYSYYYLDVWGKGTTVTVSS | 1018 | ARHWYY GDYGNYS YYYLDV |

| SEQUENCE_ID | SEQ ID NOS | aa | SEQ ID NOS | cdr3_aa |
|---|---|---|---|---|
| KAPPA | | | | |
| COVD21_P1_K_A4-p1389 | 503 | DIQMTQSPSSLSASVGDRVTITCRASQSI SSYLNWYQQKPGKAPKLLIYAASSLQSG VPSRFSGSGSGTDFTLTISSLQPEDFATY YCQQSYSTPRTFGQGTKVEIK | 504 | QQS YST PRT |
| COVD21_P1_K_B5-p1389 | 507 | DIQMTQSPSSLSASVGDRVTITCRASQSI SSYLNWYQQKPGKAPKLLIYAASSLQSG VPSRFSGSGSGTDFTLTISSLQPEDFATY YCQQSYSTPRTFGQGTKVEIK | 508 | QQS YST PRT |
| COVD21_P1_K_C12-p1389 | 511 | DIQMTQSPSSLSASVGDRVTITCRASQSI SSYLNWYQQKPGKAPKLLIYAASSLQSG VPSRFSGSGSGTDFTLTISSLQPEDFATY YCQQSYSTPRTFGQGTKVEIK | 512 | QQS YST PRT |

TABLE 8-continued

Anti-SARS-CoV-2 IgG antibodies from COV21

| | | | | |
|---|---|---|---|---|
| COVD21_P1_K_E4-p1389 | 515 | DIQMTQSPSSLSASVGDRVTITCRASQSISSYYLNWYQQKPGKAPKLLIYAASSLQSGVPSRFSGSGSGTDFTLTISSLQPEDFATYYCQQSYSTPRTFGQGTKVEIK | 516 | QQSYSTPRT |
| COVD21_P1_K_F1-p1389 | 519 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 520 | QQSYSTPRT |
| COVD21_P2_K_B7-p1389 | 523 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 524 | QQSYSTPRT |
| COVD21_P2_K_B9-p1389 | 527 | DIQMTQSPXSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 528 | QQSYSTPRT |
| COVD21_P2_K_E1-p1389 | 531 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 532 | QQSYSTPRT |
| COVD21_P2_K_E11-p1389 | 535 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 536 | QQSYSTPRT |
| COVD21_P2_K_F6-p1389 | 539 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 540 | QQSYSTPRT |
| COVD21_P3_K_A6-p1389 | 543 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 544 | QQSYSTPRT |
| COVD21_P3_K_B12-p1389 | 547 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 548 | QQSYSTPRT |
| COVD21_P3_K_B12-p1389 | 551 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK | 552 | QQSYSTPRT |
| COVD21_P1_K_C8-p1389 | 555 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 556 | QQYDNLPIT |
| COVD21_P1_K_F12-p1389 | 559 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 560 | QQYDNLPIT |
| COVD21_P2_K_H9-p1389 | 563 | DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK | 564 | QQYDNLPIT |
| LAMBDA | | | | |
| COVD21_P2_L_E5-p1409 | 567 | QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVX | 568 | AAWDDSLNGPV |

TABLE 8-continued

Anti-SARS-CoV-2 IgG antibodies from COV21

| | | | | |
|---|---|---|---|---|
| COVD21_P2_L_F8-p1409 | 571 | QSVLTQPPSASGTPGQRVTVSCSGSSSN IGSNTVNWYQQLPGTAPKLLIHSNNQR PSGVPDRFSGSKSGTSASLAISGLQSEDE ADYYCAAWDDSLNGPVFGGGTKLTVL | 572 | AA WD DSL NGP V |
| COVD21_P2_L_G5-p1409 | 575 | QSVLTQPPSASGTPGQRVTVSCSGSSSN IGSNTINWYQQLPGTAPKLLIYSNNQRP SGVPDRFSGSKSGTSASLAISGLQSEDEA NYYCAAWDDSLNGPVFGGGTKLTVL | 576 | AA WD DSL NGP V |

KAPPA

| | | | | |
|---|---|---|---|---|
| COVD21_P1_K_A11-p1389 | 579 | DIQMTQSPSSLSASVGDRVTITCRASQSI SSYLNWYHQKPGKAPKLLIYTASSLQSG VPSRFSGSGSGTDFTLTISSLQPEDFATY YCQQSYSTPPWTFGQGTKVEIK | 580 | QQS YST PP WT |
| COVD21_P1_K_D1-p1389 | 583 | DIQMTQSPSSLSASVGDRVTITCRASQSI SSYLNWYQQKPGKAPKLLIYAASSLQSG VPSRFSGSGSGTDFTLTISSLQPEDFATY FCQQSYNTPPWTFGQGTKVEIK | 584 | QQS YNT PP WT |
| COVD21_P1_K_H7-p1389 | 587 | DIQMTQSPSSLSASVGDRVTITCRASQSI STYLNWYQQKPGKAPKLLIYAASSLQSG VPSRFSGSGSGTDFTLTISSLQPEDFATY YCQQSYSTPPWTFGQGTKVEIK | 588 | QQS YST PP WT |

LAMBDA

| | | | | |
|---|---|---|---|---|
| COVD21_P2_L_B5-p1409 | 591 | QSVLTQPPSASGSPGQSVTISCTGTSSD VGGYNYVSWYQQHPGKAPKLMIYEVS KRPSGVPDRFSGSKSGNTASLTVSGLQA EDEADYYCSSDAGSNNVVFGGGTKLTV L | 592 | SSD AGS NNV V |
| COVD21_P3_L_B5-p1409 | 595 | QSALTQPPSASGSPGQSVTISCTGTSSD VGGYNYVSWYQQHPGKAPKLMIYEVS KRPSGVPDRFSGSKSGNTASLTVSGLQA EDEAEYYCSSDAGSNNVVFGGGTKLTVL | 596 | SSD AGS NNV V |

KAPPA

| | | | | |
|---|---|---|---|---|
| COVD21_P1_K_F9-p1389 | 599 | EIVLTQSPGTLSLSPGERATLSCRASQSV RSSYLAWYQQKPGQAPRLLIYGASSRAT GIPDRFSGSGSGTDFTLTISRLEPEDFAV YYCQQYGSSPWTFGQGTKVEIK | 600 | QQY GSS PW T |
| COVD21_P2_K_F10-p1389 | 603 | EIVLTQSPXSLSLSPGERATLSCRASQSVS SSYLAWYQQKPGQAPRLLIYGASSRATG IPDRFSGSGSGTDFTLTISRLEPEDFAVYY CQQYGSSPWTFGQGTKVEIK | 604 | QQY GSS PW T |
| COVD21_P1_K_E9-p1389 | 607 | DIVMTQSPLSLPVXPGEPASISCRSSQSL LHSNGFHFLEWYLQKPGQSPQLLIYSGS NRASGVPDRFSGSGSGTHFTLKISRVEA EDVGVYYCMQGLQTPLTFGGGTKVEIK | 608 | MQ GLQ TPL T |
| COVD21_P1_K_G2-p1389 | 611 | DIVMTQSPLSLPVTPGEPASISCRSSQSL LHSNGFHFLDWYLQKPGQTPQLLIYVG SNRASGVPDRFSGSGSGTDFTLKISRVE AEDVGVYYCMQALQTPLTFGGGTKVEI K | 612 | MQ ALQ TPL T |
| COVD21_P1_K_G4-p1389 | 615 | DIQMTQSPSTLSASVGDRVTITCRASQSI SSWLAWYQQKPGKAPKLLIYKASSLESG VPSRFSGSGSGTEFTLTISSLQPDDFATY YCQQYNSYSTFGQGTKVEIK | 616 | QQY NSY ST |
| COVD21_P2_K_B2-p1389 | 619 | DIQMTQSPSTLSASVGDRVTITCRASQSI SSWLAWYQQKPGKAPKLLIYKASSLESG VPSRFSGSGSGTEFTLTISSLQPDDFATY YCQQYNSYSTFGQGTKVEIK | 620 | QQY NSY ST |

TABLE 8-continued

Anti-SARS-CoV-2 IgG antibodies from COV21

LAMBDA

| Name | SEQ ID | Sequence | SEQ ID | CDRs |
|---|---|---|---|---|
| COVD21_P1_L_F2-p1409 | 623 | QSVLTQPASVSGSPGQSITISCTGTSSGVGGYNFVSWYQQHPGKAPKLMIYDVSNRPSGVSNRFSGSKSGNTASLTISGLQAEDEADYHCSSYTSRSTLGVFGGGTKLTVL | 624 | SSY<br>TSR<br>STL<br>GV |
| COVD21_P2_L_E2-p1409 | 627 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL | 628 | SSY<br>TSSS<br>TVV |

KAPPA

| Name | SEQ ID | Sequence | SEQ ID | CDRs |
|---|---|---|---|---|
| COVD21_P1_K_B10-p1389 | 631 | DIQMTQSPSTLSASVGDSVTITCRASQSISSWLAWYQQKPGKAPKLLIYKASSLESGVPSRFSGSGSGTEFTLTISSLQPDDFATYYCQQYNNYRYTFGQGTKLEIK | 632 | QQY<br>NNY<br>RYT |
| COVD21_P1_K_H11-p1389 | 635 | DIQMTQSPSTLSASVGDRVTITCRASQSISSWLAWYQQKPGKAPKLLIYKASSLESGVPSRFSGSGSGTEFTLTISSLQPDDFATYYCQKYNSYRYTFGQGTKLEIK | 636 | QKY<br>NSY<br>RYT |

LAMBDA

| Name | SEQ ID | Sequence | SEQ ID | CDRs |
|---|---|---|---|---|
| COVD21_P3_L_E4-p1409 | 639 | QSVLTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL | 640 | SSY<br>RGS<br>STP<br>YV |
| COVD21_P1_L_G7-p1409 | 643 | SYVLTQPPSVSVAPGKTARITCGGNSIGSKSVHWYQQKPGQAPVLVIYYDSDRPSGIPERFSGSNSGNTATLTISRVEAGDEADFHCQVWDSGWVFGGGTKLTVL | 644 | QV<br>WD<br>SG<br>WV |
| COVD21_P2_L_D10-p1409 | 647 | QSVLTQPASESGSPGQSITISCTGTSSDVGTYNLVSWYQQHPGKAPKLMIYEGSKRPSGVSNRFSGSKSGNTASLTISGLQAEDEADYYCCSYAASSTYVFGTGTKVTVL | 648 | CSY<br>AAS<br>STY<br>V |
| COVD21_P2_L_C7-p1409 | 651 | QSALTQPASESGSPGQSITISCTGTSSDVGSYNLVSWYQQHPGKAPKLMIYEGSKRPSGVSNRFSGSKSGNTASLTISGLQAEDEADYYCCSYAGSNTWVFGGGTKLTVL | 652 | CSY<br>AGS<br>NT<br>WV |
| COVD21_P1_L_B12-p1409 | 655 | QSVLTQPASVSGSPGQSITISCTGTSSDVGSYNLVSWYQQHPGKAPKLMIYEVSKRPSGVSNRFSGSKSGNTASLTISGLQAEDEADYYCCSYAGSSIVVFGGGTKLTVL | 656 | CSY<br>AGS<br>SIVV |
| COVD21_P2_L_F4-p1409 | 659 | QSALTQPASVSGSPGQSITISCTGTSSDVGGYNVVSWYQQHPGKAPKLMIYDVSNRPSGVSNRFSGSKSGNTASLTISGLQAEDEADYYCSSYTSSSTVFGTGTKVTVL | 660 | SSY<br>TSSS<br>TV |
| COVD21_P2_L_D7-p1409 | 663 | QSVLTQPASVSGSPGQSITISCTGTNSDVGGYNYVSWYQQHPGKAPKLMIYDVGNRPSGVSNRFSGSKSGNTASLTISGLQAEDEADYYCSSYTSSSTLVFGGGTKLTVL | 664 | SSY<br>TSSS<br>TLV |
| COVD21_P2_L_C1-p1409 | 667 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL | 668 | SSY<br>TSSS<br>TYV |

KAPPA

| Name | SEQ ID | Sequence | SEQ ID | CDRs |
|---|---|---|---|---|
| COVD21_P1_K_G5-p1389 | 671 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPSFGQGTKVEIK | 672 | QQS<br>YST<br>PPS |

TABLE 8-continued

Anti-SARS-CoV-2 IgG antibodies from COV21

LAMBDA

| | | | | |
|---|---|---|---|---|
| COVD21_P2_L_D3-p1409 | 675 | SYVLTQPPSVSVAPGKTARITCGGNNIG SKSVHWYQQKPGQAPVLVIYYDSDRPS GIPERFSGSNSGNTAILTISRVEAGDEAD YYCQVWDSSSDHVVFGGGTKLTVL | 676 | QV WD SSS DHV V |
| COVD21_P1_L_G8-p1409 | 679 | SYVLTQPPSVSVAPGKTARITCGENNIGS KSVHWYQQKPGQAPVLVIYYDSDRPSG IPERFSGSNSGNTATLTINRVEAGDEAD YYCQVWDSSSDHVVFGGGTKLTVL | 680 | QV WD SSS DHV V |
| COVD21_P2_L_E4-p1409 | 683 | QSVLTQPSSHSASSGASVRLTCMLSSGF SVGDFWIRWYQQKPGNPPRYLLYYHSD SNKGQGSGVPSRFSGSNDASANAGILRI SGLQPEDEADYYCGTWHSNSRVFGGG TKLTVL | 684 | GT WH SNS RV |

KAPPA

| | | | | |
|---|---|---|---|---|
| COVD21_P2_K_F12-p1389 | 687 | DIQMTQSPSSLSASVGDRVTITCQASQD ISNYLNWYQQKPGKAPKLLIYDASNLEA GVPSRFSGSGSGTDFTFTISSLQPEDIAT YYCQQYDNLPSFTFGPGTXVDIK | 688 | QQY DNL PSF T |
| COVD21_P1_L_B3-p1409 | 691 | QSVLTQPPSASGTPGQRVTISCSGSSSNI GSNSVNWFQQLPGTAPKLLIYSNNQRP SGVPDRFSGSKSGASASLAISGLQSEDE ADYYCASWDDSLNGPLFGGGTKLTVL | 692 | AS WD DSL NGP L |
| COVD21_P1_L_B3-p1409 | 695 | QSVLTQPPSASGTPGQRVTISCSGSSSNI GSNSVNWFQQLPGTAPKLLIYSNNQRP SGVPDRFSGSKSGASASLAISGLQSEDE ADYYCASWDDSLNGPLFGGGTKLTVL | 696 | AS WD DSL NGP L |
| COVD21_P3_L_C11-p1409 | 699 | QSVLTQPPSVSGAPGQRVTISCTGSSSNI GAGYDVHWYQQLPGTAPKLLIYGNSNR PSGVPDRFSGSKSGTSASLAITGLQAED EADYYCQSYDSSLSGVVFGGGTKLTVL | 700 | QSY DSS LSG VV |
| COVD21_P2_K_G6-p1389 | 703 | DIQMTQSPSSLSASVGDRVTITCQASQD ISNYLNWYQQKPGKAPKLLIYDASNLET GVPSRFSGSGSGTDFTFTISSLQPEDIAT YYCQQYDNLPMYTFGQGTKLEIK | 704 | QQY DNL PMY T |
| COVD21_P1_K_B2-p1389 | 707 | EIVLTQSPATLSLSPGERATLSCRASQSV SSYLAWYQQKPGQAPRLLIYDASNRAT GIPARFSGSGSGTDFTLTISSLEPEDFAVY YCQQRSNWPLTFGGGTKVEIK | 708 | QQ RSN WPL T |
| COVD21_P2_K_D2-p1389 | 711 | DIQMTQSPSSLSASVGDRVTITCQASQD ISNYLNWYQQKPGKAPKLLIYDASNLET GVPSRFSGSGSGTDFTFTISSLQPEDIAT YYCQQHDNVVTFGPGTKVEIK | 712 | QQ HD NVV T |

LAMBDA

| | | | | |
|---|---|---|---|---|
| COVD21_P3_L_B4-p1409 | 715 | QSVLTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 716 | SSY RGS STP YV |
| COVD21_P2_L_A12-p1409 | 719 | NFMLTQPHSVSESPGKTVTISCTGSSGSI ASNYVQWYQQRPGSAPTTVIYEDNQR PSGVPDRFSGSIDSSSNSASLTISGLKTED EADYYCQSYDSNHWVFGGGTKLTVL | 720 | QSY DSS NH WV |

KAPPA

| | | | | |
|---|---|---|---|---|
| COVD21_P1_K_A10-p1389 | 723 | DIQMTQSPSSLSASVGDRVTITCRASQSI SSYLNWYQQKPGKAPKVLIYAASSLQSG VPSRFSGSGSGTDFTLTISSLQPEDFATY YCQQSYSTPPLTFGGGTKVEIK | 724 | QQS YST PPL T |

TABLE 8-continued

Anti-SARS-CoV-2 IgG antibodies from COV21

LAMBDA

| | | | | |
|---|---|---|---|---|
| COVD21_P3_L_A2-p1409 | 727 | QSVLTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 728 | SSY RGS STP YV |

KAPPA

| | | | | |
|---|---|---|---|---|
| COVD21_P1_K_D3-p1389 | 731 | DIQMTQSPSSLSASVGDRVTITCRASQSI SSYLNWYQQKPGKAPKLLIYAASSLQSG VPSRFSGSGSGTDFTLTISSLQPEDFATY YCQQSYSTPGLTFGGGTKVEIK | 732 | QQS YST PGL T |

LAMBDA

| | | | | |
|---|---|---|---|---|
| COVD21_P1_L_D10-p1409 | 735 | QSVLTQPPSASGTPGQRVTISCSGSSSNI GSNYVYWYQQLPGTAPKLLIYRNNQRP SGVPDRFSGSKSGTSASLAISGLRSEDEA DYYCATWDDSLSGPVFGGGTKLTVL | 736 | AT WD DSL SGP V |
| COVD21_P3_L_H6-p1409 | 739 | QSALTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 740 | SSY RGS STP YV |
| COVD21_P3_L_D12-p1409 | 743 | QSVLTQPPSASGTPGQRVTISCSGISSNL GSNTVNWFQQLPGTAPKLLIYNSNRRP SGVPDRFSGSKSGTSASLAISGLQSEDEG DYYCAEWDDSLSTWVFGGGTHLTVL | 744 | AE WD DSL STW V |
| COVD21_P3_L_D11-p1409 | 747 | QSVLTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 748 | SSY RGS STP YV |
| COVD21_P1_L_C3-p1409 | 751 | QSVLTQPPSASGSPGQSVTISCTGTSSD VGGYKYVSWYQQHPGKAPKLMIYEVSK RPSGVPDRFSGSKSGNTASLTVSGLQAE DEADYYCSSYAGSNNHVFGGGTKLTVL | 752 | SSY AGS NN HV |
| COVD21_P2_L_F11-p1409 | 755 | SYVLTQPPSVSVAPGKTARITCGGNNIG SKSVHWYQQKPGQAPVLVIYYDSDRPS GIPERFSGSNSGNTATLTISRVEAGDEA DYYCQVWDSSSDLFGGGTKLTVL | 756 | QV WD SSS DL |

KAPPA

| | | | | |
|---|---|---|---|---|
| COVD21_P1_K_C4-p1389 | 759 | DIQMTQSPSSLSASVGDRVTITCRASQSI ASYLNWFQQKPGKAPKLLIYAASSLQSG VPSRFSGSGSGTDFTLTISSLQPEDFATY CCQQSYSSPPTFGQGTKLEIK | 760 | QQS YSS PPT |
| COVD21_P1_K_G9-p1389 | 763 | DIQMTQSPXXLSASVGDRVTITCQASQ DISNYLNWYQQKPGKAPKLLIYDASNLE TGVPSRFSGSGSGTDFTFTISSLQPEDIA TYYCQQYDNRLFTFGPGTKVDIK | 764 | QQY DNR LFT |
| COVD21_P2_K_F7-p1389 | 767 | DIQMTQSPSSLSASVGDRVTITCRASQSI SSYLNWYQQKPGKAPKLLIYAASSLQSG VPSRFSGSGSGTDFTLTISSLQPEDFATY YCQQSYNTPPITFGPGTKVDIK | 768 | QQS YNT PPIT |
| COVD21_P2_K_D1-p1389 | 771 | DIQMTQSPXSLSASVGDRVTITCRASQS ISSYLNWYQQKPGKAPKLLIYAASSLQS GVPSRFSGSGSGTDFTLTISSLQPEDFAT YFCQQSYSSTLTFGGGTKVEIK | 772 | QQS YSS TLT |

LAMBDA

| | | | | |
|---|---|---|---|---|
| COVD21_P3_L_E1-p1409 | 775 | QSALTQPASVSGSPGQSITISCTGTSSDV GGYNYVSWYRQHPGKAPKLMIYDVSN RPSGVSNRFSGSKSGNTASLTISGLQAE DEADYYCSSYTSSSTPDVFGSGTKVTVL | 776 | SSY TSSS TPD V |

TABLE 8-continued

Anti-SARS-CoV-2 IgG antibodies from COV21

| | | | | |
|---|---|---|---|---|
| COVD21_P1_L_F8-p1409 | 779 | NFMLTQPHSVSESPGKTVTISCTGSSGSI ASNYVQWYQQRPGSAPTTVIYEDNQR PSGVPDRFSGSIDSSSNSASLTISGLKTED EADYYCQSYDSSNRWVFGGGTKLTVL | 780 | QSY DSS NR WV |
| COVD21_P3_L_D4-p1409 | 783 | QSALTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 784 | SSY RGS STP YV |

KAPPA

| | | | | |
|---|---|---|---|---|
| COVD21_P2_K_D4-p1389 | 787 | DVVMTQSPLSLPVTLGQPASISCRSSQS LVYSDGNTYLNWFQQRPGQSPRRLIYK VSNRDSGVPDRFSGSGSGTDFTLKISRV EAEDVGVYYCMQGTHWPPYTFGQGTK LEIK | 788 | MQ GTH WP PYT |
| COVD21_P2_K_G9-p1389 | 791 | DIQMTQSPSSLSASVGDRVTITCRASQSI SSYLNWYQQKPGKAPKLLIYAASSLQSG VPSRFSGSRSGTDFTLTISSLQPEDFATY YCQQSYSTPPLTFGGGTKVEIK | 792 | QQS YST PPL T |
| COVD21_P1_K_H9-p1389 | 795 | DIQMTQSPSTLSASVGDRVTITCRANQS ISSWLAWYQQKPGKAPKLLIYKASSLES GVPSRFSGSGSGTEFTLTISSLQPDDFAT YYCQQYNSYWTFGQGTKVEIK | 796 | QQY NSY WT |
| COVD21_P2_K_G8-p1389 | 799 | DIQMTQSPSSLSASVGDRVTITCQASQD INNYLNWYQQKPGKAPKLLIYDASNLET GVPSRFSGSGSGTDFAFTISSLQPEDIAT YYCQQYDNLPRTFGQGTKVEIK | 800 | QQY DNL PRT |
| COVD21_P2_K_E12-p1389 | 803 | DIQMTQSPSSLSASVGDRVTITCQASQD ISNYLNWYQQKPGKAPELLIYDASNLET GVPSRFSGSGSGTDFTFTISSLQPEDIAT YYCQQYDNLPLTFGGGTKVEI | 804 | QQY DNL PLT |
| COVD21_P3_K_H4-p1389 | 807 | EIVLTQSPATLSLSPGERATLSCRASQSV SSYLAWYQQKPGQAPRLLIYDASNRAT GIPARFSGSGSGTDFTLTISSLEPEDFAVY YCQQRSNWPLTFGGGTKVEIK | 808 | QQ RSN WPL T |
| COVD21_P2_K_C4-p1389 | 811 | EIVLTQSPXXLSLSPGERATLSCRASQSVS SRNLAWYQQKPGQAPRLLIDGASSRAT GIPDRFSGSGSGTDFTLTISRLEPEDFAV YYCQQYGSSPAITFGQGTRLEIK | 812 | QQY GSS PAIT |
| COVD21_P2_K_G2-p1389 | 815 | DIQMTQSPSSLSASVGDRVTITCRASQSI SSYLNWYQQKPGIAPKLLIYAASSLQSG VPSRFSGIGSGTDFTLTISSLQPEDFATYY CQQSYSTPWTFGQGTKVEIK | 816 | QQS YST PW T |
| COVD21_P1_K_H10-p1389 | 819 | DIQMTQSPSSLSASVGDRVTITCRASQSI SSYLNWYQQRPGKAPKLLIYAASSLQSG FPSRFSGSGSGTDFTLTISSLQPEDFATYY CQQSYSTLMYTFGQGTKLEI | 820 | QQS YSTL MYT |
| COVD21_P2_K_B1-p1389 | 823 | DIVMTQSPXSLAVSLGERATINCKSSQS VLYSSNNKNYLAWYQQKPGQPPKLLIY WASTRESGVPDRFSGSGSGTDFTLTISSL QAEDVAVYYCQQYYSTPFTFGPGTKVDI K | 824 | QQY YST PFT |
| COVD21_P3_L_E6-p1409 | 827 | QSVLTQPPSASGTPGQRVTISCSGSSSNI GSNTVNWYQQLPGTGPKLLIYSNNERP SGVPDRFSGSKSGTSASLAISGLQPEDEA DYYCAAWDDSLNGPVFGTGTKVTVL | 828 | AA WD DSL NGP V |
| COVD21_P3_L_A5-p1409 | 831 | QSVLTQPRSVSGSPGQSVTISCTGTSSD VGGYNYVSWYQQHPGKAPKLMIYDVS KRPSGVPDRFSGSKSGNTASLTISGLQA EDEADYYCCSYAGSFWVFGGGTKLTVL | 832 | CSY AGS FW V |

TABLE 8-continued

Anti-SARS-CoV-2 IgG antibodies from COV21

| COVD21_P3_L_C12-p1409 | 835 | QSVLTQPASVSGSPGQSITISCAGTSSDV GAYNYVSWYQQHPGKAPKLMIYDVSN RPSGVSNRFSGSKSGNTASLTISGLQAE DEADYYCSSYTSSSTWVFGGGTKLTVL | 836 | SSY TSSS TW V |
| --- | --- | --- | --- | --- |
| COVD21_P2_K_D8-p1389 | 839 | DIQMTQSPSSVSASVGDRVTITCRASQ GISSWLAWYQQKPGKAPKLLIYAASSLQ SGVPSRFSGSGSGTDFTLTISSLQPEDFA TYYCQQANSLPLTFGGGTKVEIK | 840 | QQ ANS LPLT |
| COVD21_P1_K_B11-p1389 | 843 | DVVMTQSPLSLPVTLGQPASISCRSSQS LVFSDGNTYLNWFQQRPGQSPRRLIYK VSNRDSGVPDRFSGSGSGTDFTLKISRV EAEDVGVYFCMQGTHWPWTFGQGTK VEIK | 844 | MQ GTH WP WT |
| COVD21_P1_K_C9-p1389 | 847 | DVVMTQSPLSLPVTLGQPASISCRSSQS LVYIDGNTYLNWFQQRPGQSPRRLIYKV SNRDSGVPDRFSGSGSGTDFTLKISRVE AEDVGVYYCMQGTHWPYTFGQGTKLE IK | 848 | MQ GTH WP YT |

LAMBDA

| COVD21_P3_L_H8-p1409 | 851 | QSVLTQPPSVSGAPGQRVTISCTGSSSNI GAGYDVHWYQQLPGTAPKLLIYGNSNR PSGVPDRFSGSKSGTSASLAITGLQAED EADYYCQSYDSSLSGPYVFGTGTKVTVL | 852 | QSY DSS LSG PYV |
| --- | --- | --- | --- | --- |
| COVD21_P2_L_E10-p1409 | 855 | QSVLTQPRSVSGSPGQSVTISCTGTSSD VGGYNYVSWYQQHPGKAPKLMIYDVS KRPSGVPDRFSGSKSGNTASLTISGLQA EDEADYYCCSYAGSYTYVFGTGTKVTVL | 856 | CSY AGS YTY V |

KAPPA

| COVD21_P2_K_A4-p1389 | 859 | AIQLTQSPSSLSASVGDRVTITCRASQGI SSALAWYQQKPGKAPKFLIYDASSLESG VPSRFSGSGSGTDFTLTISSLQPEDFATY YCQQFNNYPLTFGGGTKVEIK | 860 | QQF NNY PLT |
| --- | --- | --- | --- | --- |
| COVD21_P2_K_G11-p1389 | 863 | DIVMTQSPLSLPVTPGEPASISCRSSQSL LHSNGYNYLDWYLQKPGQSPQLLIYLGS NRASGVPDRFSGSGSGTDFTLKISRVEA EDVGVYYCMQALQTPITFGQGTRLEIK | 864 | MQ ALQ TPIT |

LAMBDA

| COVD21_P3_L_G10-p1409 | 867 | QSVLTQPASVSGSPGQSITISCTGTSSDV GGYNYVSWYQQHPGKAPKLIIYNVSNR PSGVSNRFSGSKSGNTASLTISGLQAED EADYYCSSYISSNTVFGGGTKLTVL | 868 | SSYI SSN TV |
| --- | --- | --- | --- | --- |
| COVD21_P1_L_H2-p1409 | 871 | SYVLTQPPSVSVSPGQTARITCSGDALP NQYAYWYQQKPGQAPVLVIYKDSERPS GIPERFSGSSSGTTVTLTISGVQAEDEAD YYCQSADSRGVFGGGTKLTVL | 872 | QSA DSR GV |
| COVD21_P1_L_A8-p1409 | 875 | SYVLTQPPSVSVAPGKTARITCGGNNIG SKSVHWYQQKPGQAPVLVIYYDSDRPS GIPERFSGSNSGNTATLTISRVEAGDEA DYYCQVWDSSSDHLYWVFGGGTKLTV L | 876 | QV WD SSS DHL YW V |

KAPPA

| COVD21_P2_K_A3-p1389 | 879 | EIVLTQSPVSLSLSPGERATLSCRASQSVS SSYLAWYQQKPGQAPRLLIYGASSRATG IPDRFSGSGSGTDFTLTISRLEPEDFAVYY CQQYGSSPGTFGQGTKVEIK | 880 | QQY GSS PGT |

TABLE 8-continued

Anti-SARS-CoV-2 IgG antibodies from COV21

LAMBDA

| | | | | |
|---|---|---|---|---|
| COVD21_P3_L_G1-p1409 | 883 | QSVLTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 884 | SSY RGS STP YV |

KAPPA

| | | | | |
|---|---|---|---|---|
| COVD21_P2_K_A2-p1389 | 887 | DIQLTQSPSFLSASVGDRVTITCRASQGI SSYLAWYQQKPGKAPKLLIYAASTLQSG VPSRFSGSGSGTEFTLTISSLQPEDSATYY CQHLNGFGPGTKVDIK | 888 | QHL NG |
| COVD21_P1_K_F7-p1389 | 891 | DIQMTQSPSSLSASVGDRVTITCRASQG ISNSLAWYQQKPGKAPKLLLYAASRLES GVPSRFSGSGSGTDYTLTINSLQPEDFAT FYCQQYYSTPRTFGQGTKVEIK | 892 | QQY YST PRT |
| COVD21_P2_K_C8-p1389 | 895 | EIVLTQSPGTLSLSPGERATLSCRASQSV SSSYLAWYQQKPGQAPRLLIYGASSRAT GIPDRFSGSGSGTDFTLTISRLEPEDFAV YYCQQYGSSPRTFGQGTKVEIK | 896 | QQY GSS PRT |
| COVD21_P2_K_A10-p1389 | 899 | EIVLTQSPGTLSLSPGERATLSCRASQSV SSTYLAWYQQKPGQAPRLLIYGASSRAT GIPDRFSGSGSGTDFTLTISRLEPEDFAV YYCQQYGSSPRTFGQGTKLEIK | 900 | QQY GSS PRT |
| COVD21_P2_K_B12-p1389 | 903 | DIQLTQSPSFLSASVGDRVTVTCRASQG ISSYLAWYQQKPGKAPKLLIYAASTLQSG VPSRFSGSGSGTEFTLTISSLQPEDFATXY CQQVNSYSHFGGGSKAEI | 904 | QQ VNS YSH |

LAMBDA

| | | | | |
|---|---|---|---|---|
| COVD21_P3_L_C9-p1409 | 907 | QSVLTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 908 | SSY RGS STP YV |

KAPPA

| | | | | |
|---|---|---|---|---|
| COVD21_P2_K_H7-p1389 | 911 | DIQMTQSPXSLSASVGDRVTITCRASQS ISSYLNWYQQKPGKAPKLLIYAASSLQS GVPSRFSGSGSGTDFTLTISSLQPEDFAT YYCQQSYSTWTFGQGTKVEIK | 912 | QQS YST WT |

LAMBDA

| | | | | |
|---|---|---|---|---|
| COVD21_P2_L_F1-p1409 | 915 | NFMLTQPHSVSESPGKTVTISCTGSSGSI ASNYVQWYQQRPGSAPTTVIYEDNQR PSGVPDRFSGSIDSSSNSASLTISGLKTED EADYYCQSYDSGNVVFGGGTKLTVL | 916 | QSY DSG NVV |
| COVD21_P2_L_C10-p1409 | 919 | SYVLTQPPSVSVSPGQTARITCSGDALP KQYAFWYQQKPGQAPVLVIYKDSERPS GIPERFSGSSSGTTVTLTISGVQAEDEAD YYCQSADSSGTYVVFGGGTRLTVL | 920 | QSA DSS GTY VV |

KAPPA

| | | | | |
|---|---|---|---|---|
| COVD21_P3_K_H10-p1389 | 923 | DIQMTQSPSSLSASVGDRVTITCRASQSI SSYLNWYQQKPGKAPKLLIYVASSLQSG VPSRFSGSGSGTDFTLTISSLQPEDFATY YCQQSYSTRTFGQGTKVEIK | 924 | QQS YST RT |
| COVD21_P1_K_D8-p1389 | 927 | EIVLTQSPGTLSLSPGERATLSCRASQSV SSSYLAWYQQKPGQAPRLLIYGASSRAT GIPDRFSGSGSGTDFTLTISRLEPEDFAV YYCQQYGSSPYTFGQGTKLEIK | 928 | QQY GSS PYT |

TABLE 8-continued

Anti-SARS-CoV-2 IgG antibodies from COV21

LAMBDA

| COVD21_P1_L_D9-p1409 | 931 | SYVLTQPPSVSVSPGQTARITCSGDALP KQYAYWYQQKPGQAPVLVIYKDSERPS GIPERFSGSSSGTTVTLTISGVQAEDEAD YYCQSADSRKVVFGGGTKLTVL | 932 | QSA DSR KVV |
| --- | --- | --- | --- | --- |
| COVD21_P3_L_G3-p1409 | 935 | QSVLTQPPSASGTPGQRVTISCSGSSSNI GSNTVNWYQQLPGTAPKLLIYSNNQRP SGVPDRFSGSKSGTSASLAISGLQSEDEA DYYCAAWDDSLNGYVFGTGTKVTVL | 936 | AA WD DSL NGY V |
| COVD21_P2_L_A5-p1409 | 939 | SYVLTQPPSVSVAPGKTARITCGGNDIG SNGVYWYQQKPGQAPVLVIYYDSRPS GIPERFSGSNSGNTATLTISRVEAGDEA DYYCQVWDSSSDHVVFGGGTKLTVL | 940 | QV WD SSS DHV V |

KAPPA

| COVD21_P1_K_E10-p1389 | 943 | EIVLTQSPATLSLSPGERATLSCRASQSV SSYLAWYQQKPGQAPRLLIYDASNRAT GIPARFSGSGSGTDFTLTISSLEPEDFAVY YCQQRITFGQGTRLEIK | 944 | QQ RIT |

LAMBDA

| COVD21_P3_L_F9-p1409 | 947 | QSALTQPASVSGSPGQSITISCTGTSSDI GVYNYISWSQQHPGKAPKVMIYDVTN RPSGVXNRFSGSKSGNTASLTISGLQAE DEADYYCSSYRGSSTPYVFGTGTKVTVL | 948 | SSY RGS STP YV |
| --- | --- | --- | --- | --- |
| COVD21_P2_L_D6-p1409 | 951 | SYVLTQPPSVSVAPGKTARITCGGNNIG SKSVHWYQQKPGQAPLLVIYYDSRPS GIPERFSGSNSGNTATLTISRVEAGDETD YYCQVWDSSSDPHVVFGGGTKLTV | 952 | QV WD SSS DPH VV |
| COVD21_P1_L_G3-p1409 | 955 | QSALTQPASVSGSPGQSITISCTGTSSDV GGYNYVSWYQHHPGKAPKLMIYDVSN RPSGVSNRFSGSKSGNTASLTISGLQAE DEADYYCSSYTSSSTLEGVFGGGTKLTVL | 956 | SSY TSSS TLE GV |

KAPPA

| COVD21_P2_K_E6-p1389 | 959 | DIVMTQSPLSLPVTPGEPASISCRSSQSL LHSNGYNYLDWYLQKPGQSPQLLIYLGS NRASGVPDRFSGSGSGTDFTLKISRVEA EDVGVYYCMQALQTPHTFGGGTKVEIK | 960 | MQ ALQ TPH T |
| COVD21_P2_K_G1-p1389 | 963 | EIVLTQSPATLSLSPGERATLSCRASQSV STYLAWYQQKPGQAPRLLIYDASNRAT GIPARFSGSGSGTDFTLTISSLEPEDFAVY YCQQRSNWLFTFGPGTKVDIK | 964 | QQ RSN WLF T |
| COVD21_P3_L_G7-p1409 | 967 | QSXXTQPRSVSGSPGQSVTISCTGTSSD VGGYNCVSWYQQHPGKAPKLMIYDVS KRPSGVPDRFSGSKSGNTASLTISGLQA EDEADYYCCSYAGSYTPWVFGGGTKLT VL | 968 | CSY AGS YTP WV |
| COVD21_P2_L_D5-p1409 | 971 | QSVLTQPPSASGSPGQSVTISCTGTSSD VGGYNYVSWYQQHPGKAPKLMIYEVS KRPSGVPDRFSGSKSGNTASLTVSGLQA EDEADYYCSSYAGSNNWVFGGGTKLTV L | 972 | SSY AGS NN WV |
| COVD21_P1_L_A9-p1409 | 975 | QSVLTQEPSLTVSPGGTVTLTCASSTGA VTSGYYPSWFQQKPGQAPRALIYSTSN KHSWTPARFSGSLLGGKAALTLSGVQP EDEADYYCLLYYGGAWVFGGGTKLTVL | 976 | LLYY GGA WV |
| COVD21_P3_L_A8-p1409 | 979 | QSALTQPASVSGSPGQSITISCTGTSSDI GVYNYISWSQQHPGKAPKVMIYDVTN RPSGVSNRFSGSKSGNTASLTISGLQAE DEADYYCSSYRGSSTPYVFGTGTKVTVL | 980 | SSY RGS STP YV |

TABLE 8-continued

Anti-SARS-CoV-2 IgG antibodies from COV21

| SEQUENCE_ID | SEQ ID NO | aa | SEQ ID NO | cdr3_aa |
|---|---|---|---|---|
| COVD21_P2_L_B6-p1409 | 983 | NFMLTQPHSVSESPGKTVTISCTGSSGSIASNYVQWYQQRPGSAPTTVIYEDNQRPSGVPDRISGSIDSSSNSASLTISGLKTEDEADYYCQSYDSRNVVFGGGTRLTVL | 984 | QSYDSRNVV |
| COVD21_P2_L_B6-p1409 | 987 | NFMLTQPHSVSESPGKTVTISCTGSSGSIASNYVQWYQQRPGSAPTTVIYEDNQRPSGVPDRISGSIDSSSNSASLTISGLKTEDEADYYCQSYDSRNVVFGGGTRLTVL | 988 | QSYDSRNVV |
| COVD21_P1_L_D4-p1409 | 991 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDSLFGGGTKLTVL | 992 | QSYDSSLSDSL |
| COVD21_P2_K_H5-p1389 | 995 | DIQMTQSPVSLSASVGDRVTITCRASQSISSWLAWYQQKPGKAPKLLIYKASSLESGVPSRFSGSGSGTEFTLTISSLQPDDFATYYCQQYNSYSTFGQGTKVEIK | 996 | QQYNSYST |

LAMBDA

| COVD21_P1_L_F4-p1409 | 999 | QSVLTQPRSVSGSPGQSVTISCTGTSSDVGGYNYVSWYQQHPGKAPKLMIYDVSKRPSGVPDRFSGSKSGNTASLTISGLQAEDEADYYCYSYAGSYTFVFGGGTKLTVL | 1000 | YSYAGSYTFV |
| COVD21_P3_L_C4-p1409 | 1003 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVVFGGGTKLTVL | 1004 | QSYDSSLSGYVV |
| COVD21_P1_L_E2-p1409 | 1007 | QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL | 1008 | AAWDDSLSGYWV |

KAPPA

| COVD21_P2_K_C5-p1389 | 1011 | DIQMTQSPSTLSASVGDRVTITCRASQSISSWLAWYQQKPGKAPKLLIYKASSLESGVPSRFSGSGSGTEFTLTISSLQPDDFATYYCQQYNSFSYTFGQGTKLEIK | 1012 | QQYNSFSYT |
| COVD21_P1_K_H4-p1389 | 1015 | EIVMTQSPATLSVSPGERATLSCRASQSVSSNLAWYQQKSGQAPRLLIYGASTRATGIPARFSGSGSGTEFTLTISSLQSEDFAVYYCQQYNNWLGTFGQGTKVEFK | 1016 | QQYNNWLGT |
| COVD21_P2_K_C6-p1389 | 1019 | EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK | 1020 | QQYNNWPLT |

TABLE 9

Anti-SARS-CoV-2 IgG antibodies from COV47

| SEQUENCE_ID | SEQ ID NO | aa | SEQ ID NO | cdr3_aa |
|---|---|---|---|---|

HEAVY

| COV047_P3_IgG_43-P1369 | 1021 | EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS | 1022 | AREGEVEGYNDFWSGYSRDRYYFDY |
| COV047_P4_IgG_57-P1369 | 1025 | EVQLVESGGGLIQPGGSLRLSCAASGFSVSNNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1026 | AREGEVEGYYDFWSGYSRDRYYFDY |

TABLE 9-continued

Anti-SARS-CoV-2 IgG antibodies from COV47

| | | | | |
|---|---|---|---|---|
| COV047_P4_IgG_58-P1369 | 1029 | EVQLVESGGGLIQPGGSLRLSCAASGFTVSNNYMSWVRQAPGKGLEWVSVIYSGGSTYYADSLKGRFTISRDNSKNTLYLQMNSLRAEDTAVYYCAREGEVEGYYDFWSGYSRDRYYFDYWGQGTLVTVSS | 1030 | AREGEVEGYYDFWSGYSRDRYYFDY |
| COV047_P5_IgG_26-P1369 | 1033 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGDVEGYYDFWSGYSRDRYYFDYWGQGTLVTVSS | 1034 | AREGDVEGYYDFWSGYSRDRYYFDY |
| COV047_P5_IgG_41-P1369 | 1037 | EVQLVESGGGLIQPGGSLRLSCAASGFTVRNNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1038 | AREGEVEGYYDFWSGYSRDRYYFDY |
| COV047_P5_IgG_49-P1369 | 1041 | EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS | 1042 | AREGEVEGYYDFWSGYSRDRYYFDY |
| COV047_P3_IgG_16-P1369 | 1045 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 1046 | ARDSSEVRDHPGHPGRSVGAFDI |
| COV047_P4_IgG_12-P1369 | 1049 | EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS | 1050 | ARDSSEVRDHPGHPGRSVGAFDI |
| COV047_P4_IgG_65-P1369 | 1053 | EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS | 1054 | ARDSSEVRDHPGHPGRSVGAFDI |
| COV047_P5_IgG_57-P1369 | 1057 | EVQLVESGGGLVQPGGSLRLSCAASGFSVSTKYMTWVRQAPGKGLEWVSVLYSGGSDYYADSVKGRFTISRDNSKNALYLQMNSLRVEDTGVYYCARDSSEVRDHPGHPGRSVGAFDIWGQGTMVTVSS | 1058 | ARDSSEVRDHPGHPGRSVGAFDI |
| COV047_P3_IgG_10-P1369 | 1061 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVFYCARDRGGHDFWSGYGFYYYYGMDVWGQGTTVTVSS | 1062 | ARDRGGHDFWSGYGFYYYYGMDV |
| COV047_P5_IgG_95-P1369 | 1065 | QVQLVQSGAEVKKPGASVKVSCKASGYNFTSYGISWVRQAPGQGLEWMGWISGYNGNTNYGQKFQGGVTMTTDTSTSTAYMELRSLRSDDTAVYYCARDRGGHNFWSGYGYYYYYGMDVWGQGTTVTVSS | 1066 | ARDRGGHNFWSGYGYYYYYGMDV |
| COV047_P4_IgG_34-P1369 | 1069 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARERGYYGGKTPPFLGGQGTLVTVSS | 1070 | ARERGYYGGKTPPFL |
| COV047_P5_IgG_24-P1369 | 1073 | EVQLVESGGGLVKPGGSLRLSCAASGFTFSSYNMNWVRQAPGKGLEWVSCISSSSSYIYYADSVKGRFTISRDNAKNSLYLQMNSLRAEDTAVYYCARERGYDGGKTPPFLGGQGTLVTVSS | 1074 | ARERGYDGGKTPPFL |
| COV047_P4_IgG_91-P1369 | 1077 | QVQLVESGGGVVQPGRSLRLSCAASGFTFSSYGMHWVRQAPGKGLEWVAVTSYDGTNKYYADSVKGRFTISRDNSKNTLYLQMNSLRAEDTAVYFCAKNVGTGYNVMYYFDYWGQGTLVTVSS | 1078 | AKNVGTGYNVMYYFDY |
| COV047_P5_IgG_87-P1369 | 1081 | QVQLVESGGGVVQPGRSLRLSCAASGFTFSRYGMHWVRQAPGKGLEWVAVMSYDGSSKYYADSVKGRFTISRDNSKNTLCLQMNSLRAEDTAVYYCAKQAGPYCSGGSCYSAPFDYWGQGTLVTVSS | 1082 | AKQAGPYCSGGSCYSAPFDY |
| COV047_P4_IgG_69-P1369 | 1085 | QVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKVGLGYSSGWYGEEIDYWGQGTLVTVSS | 1086 | AKVGLGYSSGWYGEEIDY |

TABLE 9-continued

Anti-SARS-CoV-2 IgG antibodies from COV47

| | | | | |
|---|---|---|---|---|
| COV047_P5_IgG_68-P1369 | 1089 | QVQLVESGGGVVQPGRSLRLSCAASGFTFSTYG MHWVRQAPGKGLEWVAVISYDGSNKYFADSV KGRFTISRDNSKNTLYLQMNSLRPEDTAVYYCAK VGMEYSSGWYGEEIDFWGQGTLVTVSS | 1090 | AKVGME YSSGWY GEEIDF |
| COV047_P3_IgG_64-P1369 | 1093 | QVQLVESGGGVVQPGRSLRLSCAASGFTFSNYG MHWVRQAPGKGLEWVAVISYDGNNKYADSV KGRFTISRDNSKNTLYLQMNSLRAEDTAVYYCAK DPFPLAVAGTGYFDYWGQGTLVTVSS | 1094 | AKDPFPL AVAGTG YFDY |
| COV047_P5_IgG_77-P1369 | 1097 | QVQLVESGGGVVQPGRSLRLSCAASGFTFSSYG MHWVRQAPGKGLEWVAVISYDGSNKHYADSV KGRFTISRDNSKNTLYLQMNSLRAEDTAVYYCAK DPWELRQGNYFDYWGQGTLVTVSS | 1098 | AKDPWE LRQGNY FDY |
| COV047_P3_IgG_65-P1369 | 1101 | EVQLVESGGGLIQPGGSLRLSCAASGFTVSSNY MSWVRQAPGKGLEWVSVIYSGGSTYYADSVKG RFTISRDNSKNTLYLQMNSLRAEDTAVYYCARDY GDYYFDYWGQGTLVTVSS | 1102 | ARDYGD YYFDY |
| COV047_P5_IgG_27-P1369 | 1105 | EVQLVESGGGLIQPGGSLRLSCAASGFIVSSNYM SWVRQAPGKGLEWVSVIYSGGSTFYADSVKGR FTISRDNSKNTLYLQMNSLRAEDTAVYYCARDF GEFYFDYWGQGTLVTVSS | 1106 | ARDFGE FYFDY |
| COV047_P4_IgG_3-P1369 | 1109 | EVQLVESGGGLVQPGGSLRLSCAASGFSVSTKY MTWVRQAPGKGLEWVSVLYSGGSDYYADSVK GRFTISRDNSKNALYLQMNSLRVEDTGVYYCAR DSSEVRDHPGHPGRSVGAFDIWGQGTMVTVSS | 1110 | ARDSSEV RDHPGH PGRSVG AFDI |
| COV047_P5_IgG_90-P1369 | 1113 | EVQLVESGGGLVQPGGSLRLSCAASGFSVSTKY MTWVRQAPGKGLEWVSALYSGGSDYYADSVK GRFTISRDNSKNTLYLQMSSLRVEDTGVYYCARD SSEVRDHPGHPGRSVGAFDIWGQGTMVTVSS | 1114 | ARDSSEV RDHPGH PGRSVG AFDI |
| COV047_P3_IgG_24-P1369 | 1117 | EVQLVESGGGLVQPGGSQRLSCAASGFTVSSNY MSWIRQAPGKGLEWVSVIYSGGSAYYVDSVKG RFTISRDNSKNTLYLQMNSLRPEDTAVYYCARIA NYMDVWGKGTTVTVSS | 1118 | ARIANY MDV |
| COV047_P5_IgG_94-P1369 | 1121 | EVQLVESGGGLVQPGGSQRLSCAASGFTVSSNY MSWIRQAPGKGLEWVSVIYSGGSAYYVDSVKG RFTISRDNSKNTLYLQMNSLRAEDTAVYYCARIA NYMDVWGKGTTVTVSS | 1122 | ARIANY MDV |
| COV047_P3_IgG_8-P1369 | 1125 | EVQLVQSGAEVKKPGESLKISCKGSGYRFTNYWI GWVRQMPGKGLEWMGIIYPGDSDTRYSPSFQ GQVTISADKSITTAYLQWSSLKASDTAMYYCARL SDRWYSPFDPWGQGTLVTVSS | 1126 | ARLSDR WYSPFD P |
| COV047_P3_IgG_91-P1369 | 1129 | EVQLVQSGAEVKKPGESLKISCKGSGYRFTNYWI GWVRQMPGKGLEWMGIIYPGDSDTRYSPSFQ GQVTISADKSITTAYLQWSSLKASDTAMYYCARL SDRWYSPFDPWGQGTLVTVSS | 1130 | ARLSDR WYSPFD P |
| COV047_P3_IgG_77-P1369 | 1133 | QVQLVQSGAEVKKPGASVKVSCKASGYTFTSYN ITWVRQAPGQGLEWVGWISAYNGNTNYAQKF QGRVTMTTDTSTSTAYMELRSLSDDTAVYYCA RVPRGYYDRSGYYYLPHYLDYWGQGTLVTVSS | 1134 | ARVPRG YYDRSGY YYLPHYL DY |
| COV047_P5_IgG_78-P1369 | 1137 | QVQLVQSGAEVKKPGASVKVSCKASGYTFTSYGI SWVRQAPGQGLEWMGWISAYNGNTNYAQKL QGRVTMTTDTSTSTAYMELRSLSDDTAVYYCA RDSAYSGYDFFEAPRDYWGQGTLVTVSS | 1138 | ARDSAYS GYDFFEA PRDY |
| COV047_P5_IgG_21-P1369 | 1141 | QVQLVQSGAEVKKPGASVKVSCKASGYTFTSYDI SWVRQAPGQGLEWMGWINAYNGNTNYAQKL QGRVTMTTDTSTSTAYMELRSLSDDTAVYYCA RPSSSLTSYFDYWGQGTLVTVSS | 1142 | ARPSSSL TSYFDY ARVPASY |
| COV047_P3_IgG_53-P1369 | 1145 | QVQLVQSGAEVKKPGASVKVSCKASGYTFTSYGI SWVRQAPGQGLEWMGWISAYNGNTNYAQKL QGRVTMTTDTSTSTAYMELRSLSDDTAVYYCA RVPASYGDDDYYYYGMDVWGQGTTVTVSS | 1146 | GDDDYY YYYGMD V |

TABLE 9-continued

Anti-SARS-CoV-2 IgG antibodies from COV47

| | | | | |
|---|---|---|---|---|
| COV047_P4_IgG_27-P1369 | 1149 | QVQLVQSGAEVKKPGASVKVSCKASGYIFTDYSMHWVRQAPGQGLEWIGWVNPNSGGTNYAQKFQGWVTMARDTSITTVYMELSRLKSDDTAVYFCARGPLFHRLVYDFWSGYHDGFDMWGQGTMVTVSS | 1150 | ARGPLFHRLVYDFWSGYHDGFDM |
| COV047_P5_IgG_10-P1369 | 1153 | QVQLVQSGAEVKKPGASVKVSCKASGYTFTGYYLHWVRQAPGQGLEWMGWINPNSGGTNYAQKFQGWVTMTRDTSISTAYMELSRLSDDTAVYYCARTPRVYDPTLPNQWLVGEYYCDYWGQGTLVTVSS | 1154 | ARTPRVYDPTLPNQWLVGEYYCDY |
| COV047_P4_IgG_60-P1369 | 1157 | QVQLVQSGAEVKKPGASVKVSCKASGYTFTGYYIHWVRQAPGQGLEWMGWINPSGGTKYAQKFQGWVTMTRDTSITTVYMELSRLRSDDTAVYYCARGTEYNWNSAHFDPWGQGTLVTVSS | 1158 | ARGTEYNWNSAHFDP |
| COV047_P5_IgG_29-P1369 | 1161 | QVQLVQSGAEVKKPGASVKVSCMASGYTLTAYYIHWVRQAPGQGLESLGWINPRTGGTTILQKFQGWVTMTRDTSINTVYLELPRVTLADTAVYYCVRGGTWNYVGGEVWGQGTAVTVSS | 1162 | VRGGTWNYVGGEV |
| COV047_P3_IgG_61-P1369 | 1165 | QVQLVQSGAEVKKPGASVKVSCKASGYTFTSHYMHWVRQAPGQGLEWMGIINPSGGGTSYAQKFQGRVTMTRDTSMSTVYMELSSLRSEDTAVYYCASSSSTPDYYGMDVWGQGTTVTVSS | 1166 | ASSSSTPDYYGMDV |
| COV047_P4_IgG_48-P1369 | 1169 | QVQLVQSGAEVKKPGASVKVSCKASGYTFTSYYIHWVRQAPGQGLEWMGIINPSDGGTSYAQKFQGRVTMTRDTSTSTVYMELSSLRSEDTAVYSCARASTSTTNWNDALSLGCWGQGTLVTVSS | 1170 | ARASTSTTNWNDALSLGC |
| COV047_P3_IgG_78-P1369 | 1173 | QVQLVQSGAEVKKPGASVKVSCKASGYTFTTYYMHWVRQAPGQGLEWMGIINPSGGSTSYAQKFQGRVTMTRDTSTSTVYMELNSLRSEDTAVYYCARGGSSRYCSSTSCYSFGVDNFDYWGQGTLVTVSS | 1174 | ARGGSSRYCSSTSCYSFGVDNFDY |
| COV047_P4_IgG_43-P1369 | 1177 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVGYGYYFDYWGQGTLVTVSS | 1178 | ARVGYGYYFDY |
| COV047_P4_IgG_89-P1369 | 1181 | QVQLVQSGAEVKKPGSSVKVSCKASGGTFSSDAISWVRQAPGQGLEWMGGIMPIFGTANYAQKFQGRVTITADESTSTAYMELSSLRSEDTAVYYCARDLRYCSGGRCLWWFDPWGQGTLVTVSS | 1182 | ARDLRYCSGGRCLWWFDP |
| COV047_P5_IgG_15-P1369 | 1185 | QVQLVQSGAEVKKPGSSVKVSCKASGGTFSSNYAISWVRQAPGQGLEWMGGIIPIFGTANYAQKLQGRVTITTDESTSTAYMELSSLRSEDTAVYYCARYTYYYDRSGYYRPDYFDYWGQGTLVTVSS | 1186 | ARYTYYYDRSGYYRPDYFDY |
| COV047_P3_IgG_54-P1369 | 1189 | EVQLVESGGGLVKPGGSLRLSCAASGFTFSSAWMSWVRQAPGKGLEWVGRIKTKTDGGTKDYAAPVKGRFTISRDDSKNTLYLQMNSLKTEDTAVYYCTTTNDYGDYSPAYWGQGTLVTVSS | 1190 | TTTNDYGDYSPAY |
| COV047_P5_IgG_72-P1369 | 1193 | EVQLVESGGGLVKPGGSLRLSCAVSGFTFSNVWMRWVRQAPGKGXEWVGRIKSKTDGGTTXYAAPVKGRFTXSRDDSKNTLYLQMNSLKTEDTAVYYCTSQVWLRGPGDYWGQGTLVTVSS | 1194 | TSQVWLRGPGDY |
| COV047_P4_IgG_17-P1369 | 1197 | EVQLVESGGGLVKPGGSLRLSCAASGFTFSSYIMNWVRQAPGKGLEWVSSISSSSSYIYYADSVKGRFTISRDNAKNSLYLQMNSLRAEDTAVYYCAREAEWEAFDIWGQGTMVTVSS | 1198 | AREAEWEAFDI |
| COV047_P5_IgG_84-P1369 | 1201 | EVQLVESGGGLVKPGGSLRLSCAASGLTFTAYRMNWVRQAPGKGLEWLSSISNTNGDIYYADSVKGRFTISRDNAKNSLYLQMNSLRADDTAVYYCARDVASNYAYFDLWGQGTLVTVSS | 1202 | ARDVASNYAYFDL |
| COV047_P4_IgG_67-P1369 | 1205 | EVQLVESGGGLVKPGGSLRLSCAASGFTFSSYSMNWVRQAPGKGLEWVSSISSSTSYIYYADSVKGRFTISRDNAKNSLYLQMNSLRAEDTAVYYCARERYGDNWGQGTLVTVSS | 1206 | ARERYGDN |

TABLE 9-continued

Anti-SARS-CoV-2 IgG antibodies from COV47

| | | | | |
|---|---|---|---|---|
| COV047_P3_IgG_84-P1369 | 1209 | EVQLVESGGGLVKPGGSLRLSCAASGFTFSTYSMNWVRQAPGKGLEWVSSISSSSSYIYYADSVKGRFTISRDNAKNSLYLQMNSLRAEDTAVYYCARVVANWFDPWGQGTLVTVSS | 1210 | ARVVANWFDP |
| COV047_P3_IgG_40-P1369 | 1213 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREAARRYDFWSGLNWFDPWGQGTLVTVSS | 1214 | AREAARRYDFWSGLNWFDP |
| COV047_P4_IgG_36-P1369 | 1217 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSGGRHYYDSSGYYRLPLDDAFDIWGQGTMVTVSS | 1218 | AKSGGRHYYDSSGYYRLPLDDAFDI |
| COV047_P4_IgG_52-P1369 | 1221 | QVQLVESGGGVVQPGRSLRLSCADSGFTFSTYGMHWVRQAPGKGLEWVALISYDGSNKYYADSVKGRFTISGDNSKNTLYLQMNSLRAEDTAVYYCARAEWLRGAFDIWGQGTMVTVSS | 1222 | ARAEWLRGAFDI |
| COV047_P3_IgG_70-P1369 | 1225 | QVQLVESGGGVVQPGRSLRLSCAASGFTFNNYGMHWVRQAPGKGLEWVAVISYDGNNKYYADSVKDRFTISRDNSKNTLYLQMNNLRAEDTAMYYCARAGWELLRIRYYFDFWGQGTLVTVSS | 1226 | ARAGWELLRIRYYFDF |
| COV047_P4_IgG_31-P1369 | 1229 | QVQLVESGGGVVQPGRSLRLSCAASGLTFSFYAIHWVRQAPGKGLEWVAYISYEGSDKYYADSVKGRFTISRANSKSTLYLQMNSLRAEDTAVYYCYALFERGNWNDAEYWGQGTLVTVSS | 1230 | YALFERGNWNDAEY |
| COV047_P5_IgG_30-P1369 | 1233 | QVQLVESGGGVVQPGRSLRLSCAASGFTFSGYDIHWVRQAPGKGLEWVAVISYDGSSKFYADSVKGRFTISRDNSKNTLYLQMNSLRAEDTAVYYCAKDLGSSLYYDAFDIWGQGTMVTVSS | 1234 | AKDLGSSLYYDAFDI |
| COV047_P4_IgG_20-P1369 | 1237 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKVDGSYYYYYGMDVWGQGTTVTVSS | 1238 | AKVDGSYYYYYGMDV |
| COV047_P4_IgG_22-P1369 | 1241 | QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVPS | 1242 | AREQEANYYDISGYYHWGESLGY |
| COV047_P4_IgG_70-P1369 | 1245 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGRYYDSSGYNGTYEFDYWGQGTLVTVSS | 1246 | ARGGRYYDSSGYNGTYEFDY |
| COV047_P4_IgG_50-P1369 | 1249 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRKYSSGWSVVNFDYWGQGTLVTVSS | 1250 | ARDRKYSSGWSVVNFDY |
| COV047_P5_IgG_59-P1369 | 1253 | QVQLVESGGGVVQPGRSLRLSCAASGFMFSSYGMHWVRQAPGKGLEWVAVIWYDGSNKYYADSVKGRFTISRDNSKNTLYLQMNSLRAEDTAVYYCARDGLNWNVPHYGMDVWGQGTTVTVSS | 1254 | ARDGLNWNVPHYGMDV |
| COV047_P5_IgG_58-P1369 | 1257 | EVQLVESGGGLIQPGGSLRLSCAASGFTVSSNYMSWVRQAPGKGLEWVSVIYSGYSTYYVDSVKGRFTISRDNSKNTLYLQMNSLRAEDTAVYYCARVGGAHSGYDGSFDYWGQGTLVTVSS | 1258 | ARVGGAHSGYDGSFDY |
| COV047_P5_IgG_8-P1369 | 1261 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRVIYGMDVWGQGTTVTVSS | 1262 | ARDRVIYGMDV |
| COV047_P4_IgG_11-P1369 | 1265 | EVQLVETGGGLIQPGGSLRLSCAASGFTVSSNYMSWVRQAPGKGLEWVSVIYSGGSTFYADSVKGRFTISRDNSKNTLYLQMNSLRAEDTAVYYCARAISESPRYGVYWGQGTLVTVSS | 1266 | ARAISESPRYGVY |

TABLE 9-continued

Anti-SARS-CoV-2 IgG antibodies from COV47

| | | | | |
|---|---|---|---|---|
| COV047_P3_IgG_14-P1369 | 1269 | EVQLVETGGGLIQPGGSLRLSCAASEFTVSSNYMSWVRQAPGKGLEWVSLIYSGGSTYYADSVKGRFTISRDNSKNTLYLQMNSLRAEDTAVYYCARVLPFGDYFDYWGQGTLVTVSS | 1270 | ARVLPFGDYFDY |
| COV047_P5_IgG_91-P1369 | 1273 | EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMV | 1274 | ARDSSEVRDHPGHPGRSVGAFDI |
| COV047_P4_IgG_51-P1369 | 1277 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDSTPGYGDYISGQGTLVTVSS | 1278 | |
| COV047_P3_IgG_47-P1369 | 1281 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDYGDFYFDYWGQGTLVTVSS | 1282 | ARDYGDFYFDY |
| COV047_P5_IgG_71-P1369 | 1285 | EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDLRDQDGYSYGAFDYWGQGTLVTVSS | 1286 | ARDLRDQDGYSYGAFDY |
| COV047_P5_IgG_16-P1369 | 1289 | EVQLVESGGGLVQPGGSLRLSCAASGFTFSSYWMHWVRQAPGKGLVWVSHINGDGSSTSYADSVKGRFTISRDNAKNTLYLQMNSLRAEDTAVYYCASAFWQRGNFDYWGQGTLVTVSS | 1290 | ASAFWQRGNFDY |
| COV047_P3_IgG_25-P1369 | 1293 | EVQLVESGGGLVQPGGSLRLSCVASGFTFSSYWMHWVRQVPGKPVWVSHINSEGSSTNYADSVRGRFTISRDNAKDTLYLQMNNLRAEDTAVYYCARPTAVAAAGNYFYYYGMDVWGQGTTVTVSS | 1294 | ARPTAVAAAGNYFYYYGMDV |
| COV047_P4_IgG_86-P1369 | 1297 | QLQLQESGSRLVKPSQTLSLTCAVSGGSISSGGYSWSWIRQPPGKGLQWIGYIYHSGSTYYNPSLKSRVTISVDRSKNQFSLKLSSVTAADTAVYYCARFTNPNYYDSSGYYGFDYWGQGTLVTVSS | 1298 | ARFTNPNYYDSSGYYGFDY |
| COV047_P4_IgG_39-P1369 | 1301 | QVQLQESGPGLVKPSQTLSLTCAVSGDSIRSGGYYWSWVRQHPGRGLEWIGYIYFSGTTYYNPSLKSRVTISVDTSEKQFSLKLTSVDADTAVYFCARVKGWLRGYFDYWGQGAPVTVSA | 1302 | ARVKGWLRGYFDY |
| COV047_P4_IgG_83-P1369 | 1305 | QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARVAAFLDYWGQGTLVTVSS | 1306 | ARVAAFLDY |
| COV047_P3_IgG_38-P1369 | 1309 | QVQLQESGPGLVKPSGTLSLTCAVSGGSISSSNWWSWVRQPPGKGLEWIGEIYHSGTTNYNPSLKSRVTISVDKSKNQFSLKLSSVTAADTAVYYCARTWIQPHNWFDPWGQGTLVTVSS | 1310 | ARTWIQPHNWFDP |
| COV047_P4_IgG_72-P1369 | 1313 | QVQLQESGPGLVKPSETLSLTCTVSGGSISNYWSWIRQPPGKGLEWIGYIYTSGSTNYNPSLKSRVTISVDTSKNQFSLKLSSVTAADTAVYYCARGPPRLLWFGESPPTYWYFNLWGRGTLVTVSS | 1314 | ARGPPRLLWFGESPPTYWYFNL |
| COV047_P4_IgG_38-P1369 | 1317 | QVQLQESGPGLVKPSETLSLTCTVSGGSISYYWSWIRQPPGKGLEWIGYIYYSGSTNYNPSLKSRVTISVDTSKNQFSLKLSSVTAADTAVYYCARYQLAPGSGSYYNWGGYPRESEYYFDYWGQGTLVTVSS | 1318 | ARYQLAPGSGSYYNWGGYPRESEYYFDY |
| COV047_P3_IgG_5-P1369 | 1321 | QVQLQESGPGLVKPSETLSLTCTVSGGSISYYWSWIRQPPGKGLEWIGYIYYSRSTNYNPSLKSRVTISVDTSKNQFSLKLSSVTAADTAVYYCARHDTIFGVGQYYFDYWGQGTLVTVSS | 1322 | ARHDTIFGVGQYYFDY |
| COV047_P3_IgG_35-P1369 | 1325 | QVQLQESGPGLVKPSETLSLTCTVSGGSISYYWSWIRQPPGKGLEWIGYIYTSGSTNYNPSLKSRVTISVDTSKNQFSLKLSSVTAADTAVYYCARHSWLRGMADYWGQGTLVTVSS | 1326 | ARHSWLRGMADY |

TABLE 9-continued

Anti-SARS-CoV-2 IgG antibodies from COV47

| SEQUENCE_ID | SEQ ID NO | aa | SEQ ID NO | cdr3_aa |
|---|---|---|---|---|
| COV047_P3_IgG_49-P1369 | 1329 | QVQLQESGPGLVKPSETLSLTCTVSGDSMSSYFWTWIRQPPGKGLECIGYFYPSGSTNYNPSLKSRVTISIDTSKNQFSLKLSSVTAADTAVYYCARLKQQLVGFGWFDPWGQGTLVTVSS | 1330 | ARLKQQLVGFGWFDP |
| COV047_P4_IgG_23-P1369 | 1333 | QVQLQQSGPGLVKPSQTLSLTCAISGDSVSSNTAAWNWIRQSPSRGLEWLGRTYYRSKWYNDYAVSVISRIIINPDTSKNQFSLQLKSVTPEDTAVYYCARDILRDTSWPHDAFDIWGQGTMVTVSS | 1334 | ARDILRDTSWPHDAFDI |

| SEQUENCE_ID | SEQ ID NO | aa | SEQ ID NO | cdr3_aa |
|---|---|---|---|---|
| LAMBDA | | | | |
| COV047_P3_Lambda_43-P1409 | 1023 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1024 | SSYTSSSTRV |
| COV047_P4_Lambda_57-P1409 | 1027 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL | 1028 | SSYTSSTTRV |
| COV047_P4_Lambda_58-P1409 | 1031 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSISTRVFGTGTKVTVL | 1032 | SSYTSISTRV |
| COV047_P5_Lambda_26-P1409 | 1035 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1036 | SSYTSSSTRV |
| COV047_P5_Lambda_41-P1409 | 1039 | QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL | 1040 | SSYTSSSTRV |
| COV047_P5_Lambda_49-P1409 | 1043 | QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL | 1044 | SSYTSSTTRV |
| COV047_P3_Lambda_16-P1409 | 1047 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1048 | CSYAGASTFV |
| COV047_P4_Lambda_12-P1409 | 1051 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1052 | CSYAGASTFV |
| COV047_P4_Lambda_65-P1409 | 1055 | QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1056 | CSYAGASTFV |
| COV047_P5_Lambda_57-P1409 | 1059 | QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL | 1060 | CSYAGASTFV |
| KAPPA | | | | |
| COV047_P3_Kappa_10-P1389 | 1063 | DIQMTQSPSSLSASVGDRVTITCRASQGISNYLAWYQQRPGKVPKLLIFAASTLQSGVPSRFSGSGSGTDFTLTISSLQPEDVATYYCQKYNSAPRTFGQGTKVEIK | 1064 | QKYNSAPRT |
| COV047_P5_Kappa_95-P1389 | 1067 | DIQMTQSPSSLXASVGDRVTITCRASQGISNYLAWYQQKPGKVPKLLIYAASTLQSGVPSRFSGSESGTDFTLTISSLQPEDVATYYCQKYNSAPRTFGQGTKVEIK | 1068 | QKYNSAPRT |

TABLE 9-continued

Anti-SARS-CoV-2 IgG antibodies from COV47

LAMBDA

| | | | | |
|---|---|---|---|---|
| COV047_P4_Lambda_34-P1409 | 1071 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSSNYWVFGGGTKLTVL | 1072 | QSY DSS NY WV |
| COV047_P5_Lambda_24-P1409 | 1075 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSSNYWVFGGGTKLTVL | 1076 | QSY DSS NY WV |

KAPPA

| | | | | |
|---|---|---|---|---|
| COV047_P4_Kappa_91-P1389 | 1079 | DIQMTQSPSSLSASVGDRVTITCQASQD ISNYLNWYQQKPGKAPKLLIYDTSNLER GVPSRFSGSGSGSDFTFTISSLQPEDIATY YCQQYDNLPITFGQGTRLEIK | 1080 | QQ YDN LPIT |
| COV047_P5_Kappa_87-P1389 | 1083 | DIQMTQSPSSLSASVGDRVTITCQASQG ISNYLNWYQQKPGKAPKLLIYDASNLET GVPSRFSGSGSGTDFTFTISSLQPEDIATY YCQQYDNLPITFGQGTRLEIK | 1084 | QQ YDN LPIT |
| COV047_P4_Kappa_69-P1389 | 1087 | DIQMTQSPSSLSASVGDRVTITCRASQSI SSFLNWYQQKPGKAPNLLIYAASSLQSG VPSRFSGSGSGTDFTLTISSLQPEDFATYY CQQSYRTPLTFGGGTKVEIK | 1088 | QQS YRT PLT |
| COV047_P5_Kappa_68-P1389 | 1091 | DIQMTQSPSSLSASVGDRVTITCRASQSI SSYLNWYQQKPGKVPKLLIYAASSLQSG VPSRFSGSGSGTDFTLTISSLQPEDFATYY CQQSYRTPLTFGGGTKVEIK | 1092 | QQS YRT PLT |

LAMBDA

| | | | | |
|---|---|---|---|---|
| COV047_P3_Lambda_64-P1409 | 1095 | SYVLTQPPSVSVAPGQTARISCGGNNIG SKNVHWYQQKPGQAPVLVVYDDSDRP SGIPERFSGSNSGNTATLTISRVEAGDEA DYYCQVWDSSSDPWVFGGGTKLTVL | 1096 | QV WD SSS DP WV |
| COV047_P5_Lambda_77-P1409 | 1099 | SYVLTQPPSVSVAPGQTARITCGGNNIG SKNVHWYQQKPGQAPVLVVYDDSDRP SGIPERFSGSNSGTTATLTISRVEAGDEA DYYCQVWDSSSDPWVFGGGTKLTVL | 1100 | QV WD SSS DP WV |

KAPPA

| | | | | |
|---|---|---|---|---|
| COV047_P3_Kappa_65-P1389 | 1103 | EIVMTQSPATLSVSPGERATLSCRASQSV SSNLAWYQQKPGQAPRLLIYGASTRAT GIPARFSGSGSGTEFTLTISSLQSEDFAVY YCQQYNNWPRTFGQGTKVEIK | 1104 | QQ YNN WP RT |
| COV047_P5_Kappa_27-P1389 | 1107 | EIVMTQSPATLSVSPGERATLSCRASQSV SSNLAWYQQKPGQAPRLLIYGASTRATA IPARFSGSGSGTEFTLTISSLQSEDFAVYY CQQYNNWPRTFGQGTKVEIK | 1108 | QQ YNN WP RT |

LAMBDA

| | | | | |
|---|---|---|---|---|
| COV047_P4_Lambda_3-P1409 | 1111 | QSVLTQPASVSGSPGQSITISCTGTSNDV GSYTLVSWYQQYPGKAPKLLIFEVTKRSS GISNRFSGSKSGNTASLTISGLQGEDEAD YYCCSYAGASTFVFGGGTKLTVL | 1112 | CSY AGA STF V |
| COV047_P5_Lambda_90-P1409 | 1115 | QSALTQPASVSGSPGQSITISCTGTSNDV GSYTLVSWYQQKPGKAPKLLIFEDTKRSS GISNRFSGSKSGNTASLTISGLQGEDEAD YYCCSYAGTSTFVFGGGTKLTVL | 1116 | CSY AGT STF V |

TABLE 9-continued

Anti-SARS-CoV-2 IgG antibodies from COV47

KAPPA

| | | | | |
|---|---|---|---|---|
| COV047_P3_Kappa_24-P1389 | 1119 | EIVMTQSPATLSVSPGERATLSCRASQSV SSHLAWYQQKPGQAPRLLIYGASTRATG IPTRFSGSGSGTEFTLTISSLQSEDFAVYY CQQYNNWPPLTFGGGTKVEIK | 1120 | QQ YNN WP PLT |
| COV047_P5_Kappa_94-P1389 | 1123 | EIVMTQSPATLSVSPGERATLSCRASQSV SSHLAWYQQKPGQAPRLLIYGASTRATG IPTRFSGSGSGTEFTLTISSLQSEDFAVYY CQQYNNWPPLTFGGGTKVEIK | 1124 | QQ YNN WP PLT |

LAMBDA

| | | | | |
|---|---|---|---|---|
| COV047_P3_Lambda_8-P1409 | 1127 | QSVLTQEPSLTVSPGGTVTLTCGSSTGA VTSGHYPYWFQQKSGQAPRTLIYETSIK HSWTPARFSGSLLGGKAALTLSGAQPED EADYYCLLSYSGARPVFGGGTKLTVL | 1128 | LLSY SGA RPV |
| COV047_P3_Lambda_91-P1409 | 1131 | QSVLTQEPSLTVSPGGTVTLTCGSSTGA VTSGHYPYWFQQKSGQAPRTLIYETSIK HSWTPARFSGSLLGGKAALTLSGAQPED EADYYCLLSYSGARPVFGGGTKLTVL | 1132 | LLSY SGA RPV |

KAPPA

| | | | | |
|---|---|---|---|---|
| COV047_P3_Kappa_77-P1389 | 1135 | DIQMTQSPSSLSASVGDRVTITCQASQD ISNYLNWYQQKPGKPPKLLIYDASNLET GVPSRFSGSGSGTDFIFSISSLQPEDIATY YCQQYDSLPGCSFGQGTKLEIK | 1136 | QQ YDS LPG CS |
| COV047_P5_Kappa_78-P1389 | 1139 | DIQMTQSPSSLSASVGDRVTITCRASQSI SSFLNWYQQKPGKAPKLLIYAASSLHSG VPSRFSGSGSGTDPFTLTISSLQPEDFATYY CQQSYRTPPLFGGGTKVEI | 1140 | QQS YRT PPL |

LAMBDA

| | | | | |
|---|---|---|---|---|
| COV047_P5_Lambda_21-P1409 | 1143 | SYVLTQPPSVSVAPGQTARITCGGNNIG SKNVHWYQQKPGQAPVLVVYDDSDRP SGIPERFSGSNSGNTATLTISRVEAGDEA DYYCQVWDSSSDRHWVFGGGTKLTVL | 1144 | QV WD SSS DRH WV |
| COV047_P3_Lambda_53-P1409 | 1147 | SYVLTQPPSVSVSPGQTARITCSGDALPK QYAYWYQQKPGQAPVLVIYKDSERPSGI PERFSGSSSGTTVTLTISGVQAEDEADYY CQSADSSGTLWVFGGGTKLTVL | 1148 | QSA DSS GTL WV |
| COV047_P4_Lambda_27-P1409 | 1151 | QSVLTQPASVSGSPGQSITISCTGTSSDV GGYKFVSWYQQHPGKAPKLMIYEVSNR PSGVSNRFSGSKSGNTASLTISGLQAEDE ADYYCNSYTSSSTWVFGGGTKLTVL | 1152 | NSY TSS ST WV |
| COV047_P5_Lambda_10-P1409 | 1155 | QSALTQPRSVSGSPGQSVTISCTGTSSDV GGYNYVSWYQQHPGKAPKLMIYDVSK RPSGVPDRFSGSKSGNTASLTISGLQAED EADYYCCSYAGSYTWVFGGGTKLTVL | 1156 | CSY AGS YT WV |
| COV047_P4_Lambda_60-P1409 | 1159 | QSALTQPASVSGSPGQSITISCTGTSSDV GGYNYVSWYQQHPGKAPKLMIYEVSN RPSGVSNRFSGSKSGNTASLTISGLQAED EADYYCSSYTSSSTSWVFGGGTKLTVL | 1160 | SSY TSS STS WV |
| COV047_P5_Lambda_29-P1409 | 1163 | QSALTQPASVSGSPGQSITVSCAGSSTD VGGYNFVSWYQHHPGRVPKLIIYEVNN RPSGVSVRFSGSKSGNTASLTISGLQAED EADYYCTSFTSSSDSWIFGGGTKLTVL | 1164 | TSF TSS SDS WI |

KAPPA

| | | | | |
|---|---|---|---|---|
| COV047_P3_Kappa_61-P1389 | 1167 | DIQLTQSPSFLSASVGDRVTITCRASQGIS SYLAWYQQKPGKAPKLLIYGASTLQSGV PSRFSGSGSGTEFTLTISSLQPEDFATYYC QQLNSYPLCSFGQGTKLEIK | 1168 | QQL NSY PLC S |

TABLE 9-continued

Anti-SARS-CoV-2 IgG antibodies from COV47

LAMBDA

| | | | | |
|---|---|---|---|---|
| COV047_P4_Lambda_48-P1409 | 1171 | QSVLTQPPSVSGAPGQRVTISCTGSSSNI GAGYDVHWYQQLPGTAPKLLIYGNSNR PSGVPDRFSGSKSGTSASLAITGLOAEDE ADYYCQSYDSGLSGSGVVFGGGTKLTVL | 1172 | QSY DSG LSG SGV V |
| COV047_P3_Lambda_78-P1409 | 1175 | SYVLTQPPSVSVAPGQTARITCGGNNIG SKSVHWYQQKPGQAPVLVVYDDGDRP SGIPERFSGSNSGNTATLTISRVEAGDEA DYYCQVWDSSSDHYYVFGTGTKVTVL | 1176 | QV WD SSS DHY YV |

KAPPA

| | | | | |
|---|---|---|---|---|
| COV047_P4_Kappa_43-P1389 | 1179 | EIVLTQSPATLSLSPGERATLSCRASQSVS SYLAWYQQKPGQAPRLLIYDASNRATGI PARFSGSGSGTDFTLTISSLEPEDFAVYYC QQRSNWPSFGQGTKLEIK | 1180 | QQ RSN WP S |
| COV047_P4_Kappa_89-P1389 | 1183 | DIQMTQSPSSLSASVGDRVTITCRASQSI NNYLNWYQQKPGKAPKLLIYAASSLQSG VPSRFSGSGSGTDFTLTISSLQPEDFATYY CQQSYSTPRTFGPGTKVDIK | 1184 | QQS YST PRT |
| COV047_P5_Kappa_15-P1389 | 1187 | AIQLTQSPSSLSASVGDRVTITCRASQGIS TVLAWYQQKPGKTPKLLIYDASSLESGA PSRFSGSGSGTDFTLTISSLQPEDFATYYC QQFNSYQLTFGGGTKVEIK | 1188 | QQF NSY QLT |
| COV047_P3_Kappa_54-P1389 | 1191 | DIQMTQSPSSLSASVGDRVTITCRASQSI SSYLNWYQQKPGKAPKLLIYAASSLQSG VPSRFSGSGSGTAFTLTISSLQPEDFATYY CQQSYSTPLTFGGGTKVEIK | 1192 | QQS YST PLT |

LAMBDA

| | | | | |
|---|---|---|---|---|
| COV047_P5_Lambda_72-P1409 | 1195 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSSLNWVFGGGTKLTVL | 1196 | QSY DSS LN WV |
| COV047_P4_Lambda_17-P1409 | 1199 | QSVLTQPRSVSGSPGQSVTISCTGTSSDV GGYNYVSWYQQHPGKAPKLMICDVSK RPSGVPDRFSGSKSGNTASLTISGLOAED EADYYCCSYAGSYTWVFGGGTKLTVL | 1200 | CSY AGS YT WV |

KAPPA

| | | | | |
|---|---|---|---|---|
| COV047_P5_Kappa_84-P1389 | 1203 | DIQMTQSPSSLSASVGDRVTITCRASQSI SSYLNWYQQKPGKAPKLLIYAASSLQSG VPSRFSGSGSGTDFTLTISSLQPEDFATYY CQQSYSTPPLTFGGGTKVEIK | 1204 | QQS YST PPL T |

LAMBDA

| | | | | |
|---|---|---|---|---|
| COV047_P4_Lambda_67-P1409 | 1207 | QLVLTQSPSASASLGASVKLTCTLSSGHS SYAIAWHQQQPEKGPRYLMSLNSDGSH SKGDGIPDRFSGSSSGAERYLTISSLQSED EADYYCQTWGPWVFGGGTKLTVL | 1208 | QT WG PW V |

KAPPA

| | | | | |
|---|---|---|---|---|
| COV047_P3_Kappa_84-P1389 | 1211 | DIVMTQSPDSLAVSXGERATINCKSSQS VLYSSNNKNYLAWYQQKPGQPPKLLIY WASTRESGVPDRFSGSGSGTDFTLTISSL QAEDVAVYYCQQYYSTPQPSWTFGQG TKVEIK | 1212 | QQ YYS TPQ PS WT |
| COV047_P3_Kappa_40-P1389 | 1215 | DIVMTQSPDSLAVSXGERATINCKSSQS VLYSSNNKNYLAWYQQKPGQPPKLLIY WASTRESGVPDRFSGSGSGTDFTLTISSL QAEDVAVYYCQQYYSTMLTFGGGTKVE IK | 1216 | QQ YYS TML T |

TABLE 9-continued

Anti-SARS-CoV-2 IgG antibodies from COV47

LAMBDA

| | | | | |
|---|---|---|---|---|
| COV047_P4_Lambda_36-P1409 | 1219 | QSVLTQPPSVSGAPGQRVTISCTGSSSSI GAGYDVHWYQQLPGTAPKLLIYGNSNR PSGVPDRFSGSKSGTSASLAITGLQAEDE ADYYCQSYDSSLSGSWVFGGGTKLTVL | 1220 | QSY DSS LSG SW V |
| COV047_P4_Lambda_52-P1409 | 1223 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSTNHWVFGGGTKLTVL | 1224 | QSY DST NH WV |

KAPPA

| | | | | |
|---|---|---|---|---|
| COV047_P3_Kappa_70-P1389 | 1227 | DIQMTQSPSSLSASVGDRVTITCQASQD ISNYLNWYQQKPGKAPKFLIYGASNLET GVPPRFSGSGSGTDFTFIISSLQPEDIATY YCQQYDNLPPTFGGGTKVEIK | 1228 | QQ YDN LPP T |
| COV047_P4_Kappa_31-P1389 | 1231 | DVVMTQSPLSLPVTLGQPASISCRSSQSL VHSDGNIYLSWYQQRPGQSPRRLIYKVS NRDSGVPDRFSASGSGTDFTLRISRVEAE DVGVYYCMQGTHWPRTFGQGTKLEIK | 1232 | MQ GTH WP RT |
| COV047_P5_Kappa_30-P1389 | 1235 | DIQMTQSPSSLSASVGDRLTITCRASQSI TSYLNWYQQKPGKAPKLLIYAASSLQSG VPSRFSGSGSGTDFTLTISSLQPEDFATYY CQQSYSTPPWTFGQGTKVEIK | 1236 | QQS YST PP WT |

LAMBDA

| | | | | |
|---|---|---|---|---|
| COV047_P4_Lambda_20-P1409 | 1239 | QSVLTQPASVSGSPGQSITISCTGTSSDV GAYNYVSWYQQHPGKAPKLMIYEVSNR PSGVSNRFSGSKSGNTASLTISGLQAEDE ADYYCSSYTSSSTAWVFGGGTKLTVL | 1240 | SSY TSS STA WV |

KAPPA

| | | | | |
|---|---|---|---|---|
| COV047_P4_Kappa_22-P1389 | 1243 | DIQLTQSPSFLSASVGDRVTITCRASQGIS SYLAWYQQKPGKAPKLLIYGASTLQSGV PSRFSGSGSGTEFTLTISSLQPEDFASYYC QKVNSHPPGLTFGGGTKVEI | 1244 | QKV NSH PPG LT |
| COV047_P4_Kappa_70-P1389 | 1247 | EIVMTQSPATLSVSPGERATLSCRASQSV SSNLAWYQQKPGQAPRLLIYGASTRAT GIPARFSGSGSGTEFTLTISSLQSEDFAVY YCQQYNNWPPVTFGPGTKVDIK | 1248 | QQ YNN WP PVT |

LAMBDA

| | | | | |
|---|---|---|---|---|
| COV047_P4_Lambda_50-P1409 | 1251 | QSVLTQPPSVSEAPRQRVTISCSGSSSNI GNNAVNWYQQLPGKAPKLLIYYDDLLP SGVSDRFSGSKSGTSASLAISGLQSEDEA DYYCAAWDDSLNGWVFGGGTKLTVL | 1252 | AA WD DSL NG WV |

KAPPA

| | | | | |
|---|---|---|---|---|
| COV047_P5_Kappa_59-P1389 | 1255 | DIQMTQSPSSVSASVGDRVTITCRASQG ISSWLAWYQQKPGKAPKLLIYAASSLQS GVPSRFSGSGSGTDFTLTISSLQPEDFAT YYCQQANSFPPLTFGGGTKVEIK | 1256 | QQ ANS FPP LT |

LAMBDA

| | | | | |
|---|---|---|---|---|
| COV047_P5_Lambda_58-P1409 | 1259 | QSALTQPASVSGSPGQSITISCTGTSSDV GSYNLVSWYQQHPGKAPKLMIYEGSKR PSGVSNRFSGSKSGNTASLTISGLQAEDE ADYYCCSYAGSSTWVFGGGTKLTVL | 1260 | CSY AGS ST WV |

KAPPA

| | | | | |
|---|---|---|---|---|
| COV047_P5_Kappa_8-P1389 | 1263 | DIQMTQSPSSLSASVGDRVTITCQASQD ISNYLNWYQQKPGKAPKLLIYDASNLET GVPSRFSGSGSGTDFTFTISSLQPEDIATY YCQQYDNLPQTFGGGTKVEIK | 1264 | QQ YDN LPQ T |

TABLE 9-continued

Anti-SARS-CoV-2 IgG antibodies from COV47

| COV047_P4_Kappa_11-P1389 | 1267 | DIQMTQSPSSLSASVGDRVTITCQASQD ISNYLNWYQQKPGKAPKLLIYDASNLET GVPSRFSGSGSGTDFTFTISSLQPEDIATY YCQQYDNLPLTFGQGTRLEIK | 1268 | QQ YDN LPL T |

LAMBDA

| COV047_P3_Lambda_14-P1409 | 1271 | QSVLTQPPSVSGAPGQRVTISCTGSSSNI GAGYDVHWCQQLPGTAPKLLIYGYSNR PSGVPDRFSGSKSGTSASLAITGLQAEDE ADYYCQSYDINLSAWVFGGGTRLTXL | 1272 | QSY DIN LSA WV |

KAPPA

| COV047_P5_Kappa_91-P1389 | 1275 | DIVMTQSPDSLAVSXGERATINCKSSQS VLYSSNNKNYLAWYQQKPGQPPKLLIY WASTRESGVPDRFSGSGSGTDFTLTISSL QAEDVAVYYCQQYYSTPLTFGGGTKVEI K | 1276 | QQ YYS TPL T |

| COV047_P4_Kappa_51-P1389 | 1279 | DIQMTQSPSSLSASVGDRVTITCQASQD ISNYLNWYQQKPGKAPKLLIYDASNLET GVPSRFSGSGSGTDFTFTISSLQPEDIATY YCQQYDNLPITFGQGTRLEIK | 1280 | QQ YDN LPIT |

| COV047_P3_Kappa_47-P1389 | 1283 | EIVMTQSPATLSVSPGERATLSCRASQSV SSNLAWYQQKPGQAPRLLIYGASTRAT GIPARFSGSGSGTEFTLTISSLQSEDFAVY YCQQYNNWPRTFGQGTKVEIK | 1284 | QQ YNN WP RT |

LAMBDA

| COV047_P5_Lambda_71-P1409 | 1287 | QSALTQPASVSGSPGQSITISCTGTSSDV GGYNYVSWYQQHPGKAPKLMIYDVSN RPSGVSNRFSGSKSGNTASLTISGLQAED EADYYCSSYTSSSSWVFGGGTKLTVL | 1288 | SSY TSS SSW V |

| COV047_P5_Lambda_16-P1409 | 1291 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSSILWVFGGGTKLTVL | 1292 | QSY DSSI LW V |

| COV047_P3_Lambda_25-P1409 | 1295 | QSVLTQPASVSGSPGQSITISCTGTSSDV GYYNFVSWYQQHPGKAPKLMIYEVSNR PSGVSNRFSGSKSGNTASLIISGLQAEDE ADYYCSSYRSSSTLVFGGGTKLTVL | 1296 | SSY RSS STL V |

| COV047_P4_Lambda_86-P1409 | 1299 | QSVLTQPPSASGSPGQSVTISCTGTSSDV GGYNYVSWYQQHPGKAPKLMIYEVSKR PSGVPDRLSGSKSGNTASLTVSGLQAED EADYYCTSYAGSNNWVFGGGTKLTVL | 1300 | TSY AGS NN WV |

| COV047_P4_Lambda_39-P1409 | 1303 | NFMLTQPHSVSESPGKTVTISCTGSSGNI VNNYVQWYQQRPGSAPIIVIYEDTQRPS GVPDRFSGSIDTSSNSASLTISGLKTEDEA DYYCQSYDSGSHVVFGGGTKLTV | 1304 | QSY DSG SHV V |

KAPPA

| COV047_P4_Kappa_83-P1389 | 1307 | DIQMTQSPSSLSASVGDRVTITCRASQGI SNSLAWYQQKPGKAPKLLLYAASRLESG VPSRFSGSGSGTDYTLTISSLQPEDFATYY CQQYYSTRTFGQGTKVEIK | 1308 | QQ YYS TRT |

| COV047_P3_Kappa_38-P1389 | 1311 | DIQMTQSPSSLSASVGDRVTITCRASQGI SNYLAWFQQKPGKAPKSLIYAASSLQSG VPSKFSGSGSGTDFTLTISSLQPEDFATYY CQQYNSYPLFTFGPGTKVDIK | 1312 | QQ YNS YPL FT |

| COV047_P4_Kappa_72-P1389 | 1315 | DIVMTQSPDSLAVSXGERATINCKSSQS VLYSSNNKNYLAWYQQKPRQPPKLLIY WASTRESGVPDRISGSGSGTDFTLTISSL QAEDVAVYYCQQYYSTPLTFGGGTKVEI K | 1316 | QQ YYS TPL T |

TABLE 9-continued

Anti-SARS-CoV-2 IgG antibodies from COV47

LAMBDA

| SEQUENCE_ID | SEQ ID NO | aa | SEQ ID NO | cdr3_aa |
|---|---|---|---|---|
| COV047_P4_Lambda_38-P1409 | 1319 | QSVLTQPRSVSGSPGQSVTISCTGTSSDV GGYNYVSWYQQHPGKAPKLMIYDVSK RPSGVPDRFSGSKSGNTASLTISGLQAED EADYYCCSYAGSYTWVFGGGTKLTVL | 1320 | CSY AGS YT WV |
| COV047_P3_Lambda_5-P1409 | 1323 | QSVLTQPASVSGSPGQSVTISCTGTSSD VGSYNLVSWYQQHPGKAPKVMIYEDSK RPSGVSNRFSGSKSGNTASLTISGLQAED EADYYCCSYAGSSTWVFGGGTKLTVL | 1324 | CSY AGS ST WV |
| COV047_P3_Lambda_35-P1409 | 1327 | NFMLTQPHSVSESPGKTVTISCTGSSGSI ASNYVQWYQQRPGSAPTTVIYEDNQRP SGVPDRFSGSIDSSSNSASLTISGLKTEDE ADYYCQSYDSSIWVFGGGTKLTVL | 1328 | QSY DSSI WV |
| COV047_P3_Lambda_49-P1409 | 1331 | QSVLTQPPSVSGAPGQRVTISCTGSSSNI GADYDVHWYQQFPGTAPKVLIYANTNR PSGVPERFSGSKSGTSASLAITGLQAEDE ADYYCQSYDHSLNWVFGGGTKLTVL | 1332 | QSY DHS LN WV |
| COV047_P4_Lambda_23-P1409 | 1335 | QSVLTQPASVSGSPGQSITISCTGTSSDV GGYNYLSWYQQHPGKAPKLMIYEVSNR PSGVSNRFSGSKSGNTASLTISGLQAEDE ADYYCSSYTSSSTPFYVFGTGTKVTVL | 1336 | SSY TSS STP FYV |

TABLE 10

Anti-SARS-CoV-2 IgG antibodies from COV57

| SEQUENCE_ID | SEQ ID NO | aa | SEQ ID NO | cdr3_aa |
|---|---|---|---|---|
| HEAVY | | | | |
| COVD57_P1_HC_B4-1369 | 1337 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1338 | ARGVA VDWYF DL |
| COVD57_P1_HC_F6-1369 | 1341 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1342 | ARGVA VDWYF DL |
| COVD57_P1_HC_G8-1369 | 1345 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1346 | ARGVA VDWYF DL |
| COVD57_P2_HC_A2-1369 | 1349 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1350 | ARGVA VDWYF DL |
| COVD57_P2_HC_B2-1369 | 1353 | EVQLVQSGAEVKKPGESLKISCKGSGYSFTSYWTG WVRQMPGKGLEWMGIIYPGDSDTRYRPAFQGQ VTISADKSISTAYLQWSSLKASDTAMYYCARGVAV DWYFDLWGRGTLVTVSS | 1354 | ARGVA VDWYF DL |
| COVD57_P2_HC_B12-1369 | 1357 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1358 | ARGVA VDWYF DL |
| COVD57_P2_HC_C10-1369 | 1361 | EVQLVQSGAEVKKPGESLKISCKGSGYSFTSYWIG WVRQMPGKGLEWMGIIYPGDSDTRYSPSFQGQ VTISADKSISSAYLQWSSLKASDTAMYYCARGVAV DWYFDLWGRGTLVTVSS | 1362 | ARGVA VDWYF DL |

TABLE 10-continued

Anti-SARS-CoV-2 IgG antibodies from COV57

| COVD57_P2_HC_D10-1369 | 1365 | EVQLVQSGAEVKKPGESLKISCKGSGYSFTTYWIG WVRQMPGKGLEWMGIIYPADSDTRYSPSFQGQ VTISADKSISTAYLQWSSLKASDTAMYYCARGVAV DWYFDLWGRGTLVTVSS | 1366 | ARGVA VDWYF DL |
| --- | --- | --- | --- | --- |
| COVD57_P2_HC_E1-1369 | 1369 | EVQLVQSGAEVKKPGESLKISCKGSGYSFTSYWIG WVRQMPGKGLEWMGIIYPGDSDTRYSPSFQGQ VTISADKSISTAYLQWSSLKASDTAMYYCARGVAV DWYFDLWGRGTLVTVSS | 1370 | ARGVA VDWYF DL |
| COVD57_P1_HC_F3-1369 | 1373 | QVQLQESGPGLVKPSETLSLTCTVSGASINSYYWT WIRQPPGKGLEWIGYIHDSGNTNYNPALRSRVTI SLDTSKNQFSLKVRSVTAADTAVYYCAREVVVQS AKDWSHYYYYMDVWGKGTTVSVSS | 1374 | AREVV VQSAK DWSHY YYYMD V |
| COVD57_P2_HC_A6-1369 | 1377 | QVQLQESGPGLVKPSETLSLTCTVSGGSMTSYYW NWIRHTPGKDLEWIGYIDYSGNTNYNPSLRSRGTI SVDTSKNQFSLRVTSVTAADTAVYYCAREVVVSSP KDWSHYYYYMDVWGKGTTVTVSS | 1378 | AREVV VSSPKD WSHYY YYMDV |
| COVD57_P2_HC_B11-1369 | 1381 | QVQLQESGPGLVKPSETLSLTCTVSGASINSYYWT WIRQPPGKGLEWIGYIHDSGNTNYNPALRSRVTI SLDTSKNQFSLKVRSVTAADTAVYYCAREVVVQS AKDWSHYYYYMDVWGKGTTVSVSS | 1382 | AREVV VQSAK DWSHY YYYMD V |
| COVD57_P2_HC_D11-1369 | 1385 | QVQLQESGPGLVKPSETLSLTCTVSGASINSYYWT WIRQPPGKGLEWIGYIHDSGNTNYNPALRSRVTI SLDTSKNQFSLKVRSVTAADTAVYYCAREVVVQS AKDWSHYYYYMDVWGKGTTVSVSS | 1386 | AREVV VQSAK DWSHY YYYMD V |
| COVD57_P2_HC_F10-1369 | 1389 | QVQLQESGPGLVKPSETLSLTCTVSGASINSYYWT WIRQPPGKGLEWIGYIHDSGNTNYNPALRSRVTI SLDTSKNQFSLKVRSVTAADTAVYYCAREVVVQS AKDWSHYYYYMDVWGKGTTVSVSS | 1390 | AREVV VQSAK DWSHY YYYMD V |
| COVD57_P1_HC_B11-1369 | 1393 | QVQLVQSGAEVKKPGSSVKVSCKASGGTFSSYAIS WVRQAPGQGLEWMGRIIPILGIANYAQKFQGRV TITADKSTSTAYMELSSLRSEDTAVYYCARDSEYSS SWYSRGYYGMDVWGQGTTVTVSS | 1394 | ARDSEY SSSWYS RGYYG MDV |
| COVD57_P2_HC_A11-1369 | 1397 | QVQLVQSGAEVKKPGSSVKVSCKASGGTFSSYAIS WVRQAPGQGLEWMGRIIPILGIANYAQKFQGRV TITADKSTSTAYMELSSLRSEDTAVYYCARDSEYSS SWYSRGYYGMDVWGQGTTVTVSS | 1398 | ARDSEY SSSWYS RGYYG MDV |
| COVD57_P2_HC_E2-1369 | 1401 | QVQLVQSGAEVKKPGSSVKVSCKASGGTFSSYAIS WVRQAPGQGLEWMGRIIPILGIANYAQKFQGRV TITADKSTSTAYMELSSLRSEDTAVYYCARDSEYSS SWYSRGYYGMDVWGQGTTVTVSS | 1402 | ARDSEY SSSWYS RGYYG MDV |
| COVD57_P1_HC_B7-1369 | 1405 | EVQLVESGGGLVQPGGSLRLSCAASGFIFSSYWM TWVRQAPGKGLEWVASIKYNGNERNYVDSVKG RFTISRDNARNSLFLQLNNLGAEDTAVYYCARQPE STIWYYFDYWGQGTLVTVSS | 1406 | ARQPES TIWYYF DY |
| COVD57_P1_HC_F5-1369 | 1409 | EVQLVESGGGLVQPGGSLRLSCAASGFIFSSYWM TWVRQAPGKGLEWVASIKYNGNERNYVDSVKG RFTISRDNARNSLFLQLNNLGAEDTAVYYCARQPE STIWYYFDYWGQGTLVTVSS | 1410 | ARQPES TIWYYF DY |
| COVD57_P1_HC_H2-1369 | 1413 | EVQLVESGGGLVQPGGSLRLSCAASGFIFSSYWM TWVRQAPGKGLEWVASIKYNGNERNYVDSVKG RFTISRDNARNSLFLQLNNLGAEDTAVYYCARQPE STIWYYFDYWGQGTLVTVSS | 1414 | ARQPES TIWYYF DY |
| COVD57_P1_HC_D12-1369 | 1417 | QVQLQQWGAGLLKPSETLSRTCAVFGGSFTNYY WSWIRQSPGKGLEWIGEINDSGITNYNPSLKSRV TISVDTSKNQFSLSLRSVTAADTAVYYCARRRSFSR PSSIDYWGQGTLVTVSS | 1418 | ARRRSF SRPSSI DY |

TABLE 10-continued

Anti-SARS-CoV-2 IgG antibodies from COV57

| | | | | |
|---|---|---|---|---|
| COVD57_P2_HC_B6-1369 | 1421 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 1422 | ARRRSFSRPSSIDY |
| COVD57_P2_HC_H7-1369 | 1425 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 1426 | ARRRSFSRPSSIDY |
| COVD57_P2_HC_H7-1369 | 1429 | QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS | 1430 | ARRRSFSRPSSIDY |
| COVD57_P1_HC_E6-1369 | 1433 | QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAANHCSGGSCYDGFDIWGQGTMVTVSS | 1434 | AANHCSGGSCYDGFDI |
| COVD57_P2_HC_H6-1369 | 1437 | QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPYCSGGSCNDAFDIWGQGTMVTVSS | 1438 | AAPYCSGGSCNDAFDI |
| COVD57_P2_HC_A10-1369 | 1441 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS | 1442 | TTDPHCSSTSCPIFYYYYMDV |
| COVD57_P2_HC_C4-1369 | 1445 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS | 1446 | TTDPHCSSTSCPIFYYYYMDV |
| COVD57_P2_HC_C4-1369 | 1449 | EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS | 1450 | TTDPHCSSTSCPIFYYYYMDV |
| COVD57_P1_HC_E9-1369 | 1453 | QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS | 1454 | AKSPMGYCTNGVCYPDS |
| COVD57_P2_HC_G5-1369 | 1457 | QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS | 1458 | AKSPMGYCTNGVCYPDS |
| COVD57_P2_HC_G5-1369 | 1461 | QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS | 1462 | AKSPMGYCTNGVCYPDS |
| COVD57_P1_HC_F10-1369 | 1465 | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS | 1466 |ARAGFGVVITYGSGTDPLFDY |
| COVD57_P1_HC_H3-1369 | 1469 | QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS | 1470 | ARAGFGVVITYGSGTDPLFDY |
| COVD57_P1_HC_A5-1369 | 1473 | QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCAREYLERYFDGGQRWISYYYMDVWGKGTAVTVSS | 1474 | AREYLERYFDGGQRWISYYYMDV |
| COVD57_P1_HC_A9-1369 | 1477 | QVQLVQSGAEVKKPGASVKVSCKASGYTFSNYYIHWVRQAPGKGLEWMGMINPNGGTTRYPLKFQGRVTMTRDTSTRTVYMELNSLRSEDTALYFCAREIPDILEVVAATGSLDDWGQGSLVTVS | 1478 | AREIPDILEVVAATGSLDD |

TABLE 10-continued

Anti-SARS-CoV-2 IgG antibodies from COV57

| | | | | |
|---|---|---|---|---|
| COVD57_P1_HC_A11-1369 | 1481 | QVQLVQSGAEVKKPGSSVKVSCKASGGTFSSYAIS WVRQAPGQGLEWMGRIIPILGIANYAQKFQGRV TITADKSTSTAYMELSSLRSEDTAVYYCARDSEYSS SWYSRGYYGMDVWGQGTTVTVSS | 1482 | ARDSEY SSSWYS RGYYG MDV |
| COVD57_P2_HC_B1-1369 | 1485 | QVQLVQSGAEVKKPGSSVKVSCKASGGTFSSYTIS WVRQAPGQGLEWMGRIIPILGIANYAQKFQGRV TITADKSTSTAYMELSSLRSEDTAVYYCARDSGYSG YGSTYYMDVWGKGTTVTVSS | 1486 | ARDSG YSGYGS TYYMD V |
| COVD57_P1_HC_F11-1369 | 1489 | QVQLVQSGAEVKKPGSSVKVSCKASGGTFSSYAIS WVRQAPGQGLEWMGRIIPILGIANYAQKFQGRV TITADKSTSTAYMELSSLRSEDTAVYYCARDSEYSS SWYSRGYYGMDVWGQGTTVTVSS | 1490 | ARDSEY SSSWYS RGYYG MDV |
| COVD57_P2_HC_G11-1369 | 1493 | EVQLVQSGPVLVKPGPSVKISCKASGFTFTDYYM HWVKQSHGKSLEWIGLVYPYNGGTSYNQKFKGK ATLTVDTSSSTAYMELNSLTSEDSAVYYCARSGPD YFDYWGQGTTLTVSS | 1494 | ARSGP DYFDY |
| COVD57_P2_HC_C12-1369 | 1497 | EVQLVESGGGLVQPGGSLRLSCAASGFTFSSYDM HWVRQATGKGLEWVSAIGTAGDTYYPGSVKGRF TISRENAKNSLYLQMNSLRAGDTAVYYCARGTTF NHYYYMDVWGKGTTVTVSS | 1498 | ARGTTF NHYYY MDV |
| COVD57_P2_HC_C3-1369 | 1501 | EVQLVESGGGLVKPGGSLRLSCAASGFTFSNAW MSWVRQAPGKGLEWVGRIKSKTDGGTTDYAAP VKGRFTISRDDSKNTLYLQMNSLKTEDTAVYYCTT DVGADSSSAYYYYYMDVWGKGTTVTVSS | 1502 | TTDVG ADSSSA YYYYY MDV |
| COVD57_P2_HC_E11-1369 | 1505 | EVQLVESGGGLVKPGGSLRLSCAASGLTFTAYRM NWVRQAPGKGLEWLSSISNTNGDIYYADSVKGR FTISRDNAKNSLYLQMNSLRADDTAVYYCARDVA SNYAYFDLWGQGTLVTVSS | 1506 | ARDVA SNYAYF DL |
| COVD57_P2_HC_H12-1369 | 1509 | EVQLLESGGGLVQPGGSLRLSCAASGFTFSSYAMS WVRQAPGKGLEWVSGMSGSGGITYYADSVKGR FTISRDNSKNTLYLQMNSLRAEDTAVYYCAKDTGS MIVELLGYWGQGTLVTVSS | 1510 | AKDTG SMIVEL LGY |
| COVD57_P2_HC_H12-1369 | 1513 | EVQLLESGGGLVQPGGSLRLSCAASGFTFSSYAMS WVRQAPGKGLEWVSGMSGSGGITYYADSVKGR FTISRDNSKNTLYLQMNSLRAEDTAVYYCAKDTGS MIVELLGYWGQGTLVTVSS | 1514 | AKDTG SMIVEL LGY |
| COVD57_P1_HC_B8-1369 | 1517 | EVQLVESGGGLVKPGRSLRLSCTASGFTFGDYAM SWFRQAPGKGLEWVGFIRSKAYGGTTEYAASVK GRFTISRDDSKSIAYLQMNSLKTEDTAVYYCTRAR SVTMVWYRYYMDVWGKGTTVTVSS | 1518 | TRARSV TMVW YRYYM DV |
| COVD57_P2_HC_C2-1369 | 1521 | EVQLVESGGGLVQPGGSLRLSCAASGFTFSSYAM HWVRQAPGKGLEYVSVISSNGGSTYYANSVKGRF TISRDNSKNTLYLQMGSLRAEDMAVYYCAREGPF LPSLYSSSRDAFDIWGQGTMVTVSS | 1522 | AREGPF LPSLYSS SRDAF DI |
| COVD57_P1_HC_C8-1369 | 1525 | EVQLVESGGGLVQPGGSLRLSCAASGFTFSSYAM HWVRQAPGKGLEYVSGISSNGGSPYYANSVKGR FTISRDNSKNTLYLQMGSLRAEDMAVYYCARGPI AAAGSYFDYWGQGTLVTVSS | 1526 | ARGPIA AAGSYF DY |
| COVD57_P1_HC_F9-1369 | 1529 | EVQLVESGGGLVQPGGSLRLSCAASGFTVSSNYM SWVRQAPGKGLEWVSVIYSGGSTYYADSVKGRFT ISRDNSKNTLYLQMNSLRAEDTAVYHCARDLAVY GMDVWGQGTTVTVSS | 1530 | ARDLA VYGMD V |
| COVD57_P1_HC_C3-1369 | 1533 | EVQLVESGGGLVQPGGSLRLSCAASGFTVSSNYM SWVRQAPGKGLEWVSVIYSGGSTYYADSVKGRFT ISRDNSKNTLYLQMNSLRAEDTAVYYCARDGEGQ RETDYWGQGTLVTVSS | 1534 | ARDGE GQRET DY |
| COVD57_P1_HC_G3-1369 | 1537 | EVQLVESGGGLVQPGGSLRLSCAASGFNFSTHW MHWVRQAPGKGLVWVSRINSDGSRRAYATSVK GRFTISRDNAKNTLYLQMDSLREDTAVYYCTRD DSSWPHFFDNWGQGTLVTVSS | 1538 | TRDDSS WPHFF DN |

TABLE 10-continued

Anti-SARS-CoV-2 IgG antibodies from COV57

| SEQUENCE_ID | SEQ ID NO | aa | SEQ ID NO | cdr3_aa |
|---|---|---|---|---|
| COVD57_P2_HC_B7-1369 | 1541 | EVQLVESGGGLVQPGGSLRLSCAASGFNFSTHW MHWVRQAPGKGLVWVSRINSDGSRRAYATSVK GRFTISRDNAKNTLYLQMDSLRDEDTAVYYCTRD DSSWPHFFDNWGQGTLVTVSS | 1542 | TRDDSS WPHFF DN |
| COVD57_P1_HC_H10-1369 | 1545 | QVQLQQWGAGLLKPSETLSRTCGVYGGSFRDYY WSWIRQSPGKGLEWIGEINHSGSTNYNPSLLGRV TISVDTSKNQFSLRLTSVTAADTAVYYCARAYVSSV SEDYFDYWGQGTLVTVSS | 1546 | ARAYVS SVSEDY FDY |
| COVD57_P1_HC_B9-1369 | 1549 | QVQLQQWGAGLLKPSETLSLTCAVYGGSFSGYY WSWIRQPPGKGLEWIGEVNHSGSTNYNPSLKSR VTISVDTSKNQFFLKLSSVTAADTAVYYCARHWM PRDYYYGMDVWGQGTTVTVSS | 1550 | ARHW MPRDY YYYGM DV |
| COVD57_P2_HC_E3-1369 | 1553 | QVQLQQWGAGLLKPSETLSRTCAVYGGSFTDYY WSWIRQSPGKGLEWIGEINHSGSTNYNPFLKSRV TLSVDTSKNQFSLKLDSLTVADTAIYYCARGAKGD SDWYFDLWGRGTLVTVSS | 1554 | ARGAK GDSDW YFDL |
| COVD57_P2_HC_F8-1369 | 1557 | QVQLQESGPGLVKPSETLSLTCTVSGGSISSYYWS WIRQPPGKGLEWIGYIHYSGSTNYNPSLKSRVTIS VDTSKNQFSLKLSSVTAADTAVYYCARHYDILTALS WFDPWGQGTLVTVSS | 1558 | ARHYDI LTALSW FDP |
| COVD57_P2_HC_H11-1369 | 1561 | QVQLQESGPGLVKPSETLSLTCTVSGGSISSYYWS WIRQPPGKGLEWIGYIYYSGSTNYNPSLKSRVTISV DTSKNQFSLKLSSVTAADTAVYYCARLLSTEWLFN WFDPWGQGTLVTVSS | 1562 | ARLLST EWLFN WFDP |
| COVD57_P2_HC_A9-1369 | 1565 | EVQLVQSGAEVKKPGESLKISCKGSGYSFTSYWIG WVRQMPGKGLEWVGIIYPGDSDTRYSPSFQGQV TISADKSISTAYLQWSSLKASDTAMYYCARGIAVD WYFDLWGRGTLVTVSS | 1566 | ARGIAV DWYFD L |

| SEQUENCE_ID | SEQ ID NO | aa | SEQ ID NO | cdr3_aa |
|---|---|---|---|---|
| LAMBDA | | | | |
| COVD57_P1L_B4-_1409 | 1339 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1340 | QSY DSS LSAL YV |
| COVD57_P1_L_F6-1409 | 1343 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1344 | QSY DSS LSAL YV |
| COVD57_P1_L_G8-1409 | 1347 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1348 | QSY DSS LSAL YV |
| COVD57_P2_L_A2-1409 | 1351 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1352 | QSY DSS LSAL YV |
| COVD57_P2_L_B2-1409 | 1355 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1356 | QSY DSS LSAL YV |
| COVD57_P2_L_B12-1409 | 1359 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSALYVFGTGTKVTVL | 1360 | QSY DSS LSAL YV |
| COVD57_P2_L_C10-1409 | 1363 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSVLYVFGTGTKVTVL | 1364 | QSY DSS LSVL YV |

TABLE 10-continued

Anti-SARS-CoV-2 IgG antibodies from COV57

| | | | | |
|---|---|---|---|---|
| COVD57_P2_L_D10-1409 | 1367 | QSVLTQPPSVSGAPGQRVTISCTGSSSNI GAGYDVHWYQQLPGTAPKLLIYGYTNR PSGVPDRFSGSKSGTSASLAITGLQAEDE ADYYCQSYDSSLSALYVFGTGTKVTVL | 1368 | QSY DSS LSAL YV |
| COVD57_P2_L_E1-1409 | 1371 | QSVLTQPPSVSGAPGQRVTISCTGSSSNI GAGSDVHWYQQLPGTAPKLLIYGNSNR PSGVPDRFSGSKSGTSASLAITGLQAEDE ADYYCQSYDSSLSALYVFGTGTKVTVL | 1372 | QSY DSS LSAL YV |

KAPPA

| | | | | |
|---|---|---|---|---|
| COVD57_P1_K_F3-1389 | 1375 | EIVLTQSPATLSLSPGERASLSCRASQSVG TYLAWYQQKVGQPPRLLIYDASNRATGI PARFSGSGSGTDFTLTISSLDPEDFAVYYC QQRSSWFVTFGQGTRLEIK | 1376 | QQ RSS WF VT |
| COVD57_P2_K_A6-1389 | 1379 | EIVLTQSPATLSLSPGERATLSCRASQSVS TYLTWYQQKPGQAPRLLIYDASNRATGI PARFSGSGSGTDFTLTITSLEPEDFALYYC QQRSTWFVTFGQGTRLEIK | 1380 | QQ RST WF VT |
| COVD57_P2_K_B11-1389 | 1383 | EIVLTQSPATLSLSPGERASLSCRASQSVG TYLAWYQQKVGQPPRLLIYDASNRATGI PARFSGSGSGTDFTLTISSLDPEDFAVYYC QQRSSWFVTFGQGTRLEIK | 1384 | QQ RSS WF VT |
| COVD57_P2_K_D11-1389 | 1387 | EIVLTQSPATLSLSPGERASLSCRASQSVG TYLAWYQQKVGQPPRLLIYDASNRATGI PARFSGSGSGTDFTLTISSLDPEDFAVYYC QQRSSWFVTFGQGTRLEIK | 1388 | QQ RSS WF VT |
| COVD_K_F10-1389 | 1391 | EIVLTQSPATLSLSPGERASLSCRASQSVG TYLAWYQQKVGQPPRLLIYDASNRATGI PARFSGSGSGTDFTLTISSLDPEDFAVYYC QQRSSWFVTFGQGTRLEIK | 1392 | QQ RSS WF VT |
| COVD57_P1_K_B11-1389 | 1395 | DIVMTQSPLSLPVTPGEPASISCRSSQSLL HSNGYNYLDWYLQKPGQSPQLLIYLGSN RASGVPDRFSGSGSGTDFTLKISRVEAED VGVYYCMQALQTPPTFGGGTKVEIK | 1396 | MQ ALQ TPP T |
| COVD57_P2_K_A11-1389 | 1399 | DIVMTQSPLSLPVTPGEPASISCRSSQSLL HSNGYNYLDWYLQKPGQSPQLLIYLGSN RASGVPDRFSGSGSGTDFTLKISRVEAED VGVYYCMQALQTPPTFGGGTKVEIK | 1400 | MQ ALQ TPP T |
| COVD57_P2_K_E2-1389 | 1403 | DIVMTQSPLSLPVTPGEPASISCRSSQSLL HSNGYNYLDWYLQKPGQSPQLLIYLGSN RASGVPDRFSGSGSGTDFTLKISRVEAED VGVYYCMQALQTPPTFGGGTKVEIK | 1404 | MQ ALQ TPP T |

LAMBDA

| | | | | |
|---|---|---|---|---|
| COVD57_P1_LB7-1409 | 1407 | SYELTQPPSVSVSPGQTARVTCSGHALP DQYTYWYQQRPGRAPVLVIYVNNQRPS GIPDRFSATTSGTTVTLTISGVQAEDEAD YYCQSADSSGSYVVFGGGTKLTVL | 1408 | QSA DSS GSY VV |
| COVD57_P1_LF5-1409 | 1411 | SYVLTQPPSVSVSPGQTARVTCSGHALP DQYTYWYQQRPGRAPVLVIYVNNQRPS GIPDRFSATTSGTTVTLTISGVQAEDEAD YYCQSADSSGSYVVFGGGTKLTVL | 1412 | QSA DSS GSY VV |
| COVD57_P1_L_H2-1409 | 1415 | SYELTQPPSVSVSPGQTARVTCSGHALP DQYTYWYQQRPGRAPVLVIYVNNQRPS GIPDRFSATTSGTTVTLTISGVQAEDEAD YYCQSADSSGSYVVFGGGTKLTVL | 1416 | QSA DSS GSY VV |

KAPPA

| | | | | |
|---|---|---|---|---|
| COVD57_P1_K_D12-1389 | 1419 | DIVMTQSPLSLPVTPGEPASISCRSSQSLL HRNGYNYLDWYLQKPGQSPQLLIYLGS NRASGVPDRFRGSGSGTDFTLKISRVEAE DVGVYYCMQALQTLTFGQGTRLEIK | 1420 | MQ ALQ TLT |

TABLE 10-continued

Anti-SARS-CoV-2 IgG antibodies from COV57

| | | | | |
|---|---|---|---|---|
| COVD57_P2_K_B6-1389 | 1423 | DIVMTQSPLSLPVTPGEPASISCRSSQSLL HRNGYNYLDWYLQKPGQSPQLLIYLGS NRASGVPDRFRGSGSGTDFTLKISRVEAE DVGVYYCMQALQTLTFGQGTRLEIK | 1424 | MQ ALQ TLT |
| COVD57_P2_K_H7-1389 | 1427 | DIVMTQSPLSLPVTPGEPASISCRSSQSLX HRNGYNYLDWYLQKPGQSPQLLIYLGS NRASGVPDRFRGSGSGTDFTLKISRVEAE DVGVYYCMQALQTLTFGQGTRLEIK | 1428 | MQ ALQ TLT |
| COVD57_P2_K_H7-1389 | 1431 | DIVMTQSPLSLPVTPGEPASISCRSSQSLX HRNGYNYLDWYLQKPGQSPQLLIYLGS NRASGVPDRFRGSGSGTDFTLKISRVEAE DVGVYYCMQALQTLTFGQGTRLEIK | 1432 | MQ ALQ TLT |
| COVD57_P1_K_E6-1389 | 1435 | EIVLTQSPGTLSLSPGERATLSCRASQSVS SSYLAWYQQRPGQAPRLLIYGASSRATG IPDRFSGSGSGTDFTLTISRLEPEDFAVYY CQQYGSSPWMFGQGTKVEIK | 1436 | QQY GSS PW M |
| COVD57_P2_K_H6-1389 | 1439 | EIVLTQSPGTLSLSPGERATLSCRASQSVS SSYLAWYQQKPGQAPRLLIYGASSRATG IPDRFSGSGSGTDFTLTISRLEPEDFAVYY CQQYGSSPWTFGQGTKVEIK | 1440 | QQY GSS PW T |

LAMBDA

| | | | | |
|---|---|---|---|---|
| COVD57_P2_L_A10-1409 | 1443 | SYVLTQPPSVSVAPGQTARITCGGNNIG SKSVHWYQQKPGQAPVLVVYDDSDRPS GIPERFSGSNSGNTATLTISRVEAGDEAD YYCQVWDSSSDQGVFGGGTKLTVL | 1444 | QV WD SSS DQ GV |
| COVD57_P2_L_C4-1409 | 1447 | SYVLTQPPSVSVAPGQTARITCGGNNIG SKSVHWYQQKPGQAPVLVVYDDSDRPS GIPERFSGSNSGNTATLTISRVEAGDEAD YYCQVWDSSSDQGVFGGGTKLTVL | 1448 | QV WD SSS DQ GV |
| COVD57_P2_L_C4-1409 | 1451 | SYVLTQPPSVSVAPGQTARITCGGNNIG SKSVHWYQQKPGQAPVLVVYDDSDRPS GIPERFSGSNSGNTATLTISRVEAGDEAD YYCQVWDSSSDQGVFGGGTKLTVL | 1452 | QV WD SSS DQ GV |
| COVD57_P1_L_E9-1409 | 1455 | NFMLTQPHSVSESPGKTVTISCTGSSGSI ASNYVQWYQQRPGSAPTTVIYEDTQRP SGVPDRFSGSIDSSSNSASLTISGLKTEDE ADYYCQSYDINSRWVFGGGTKLTVL | 1456 | QSY DIN SR WV |
| COVD57_P2_L_G5-1409 | 1459 | NFMLTQPHSVSESPGKTVTISCTGSSGSI ASNYVQWYQQRPGSAPTTVIYEDTQRP SGVPDRFSGSIDSSSNSASLTISGLKTEDE ADYYCQSYDINSRWVFGGGTKLTVL | 1460 | QSY DIN SR WV |
| COVD57_P2_L_G5-1409 | 1463 | NFMLTQPHSVSESPGKTVTISCTGSSGSI ASNYVQWYQQRPGSAPTTVIYEDTQRP SGVPDRFSGSIDSSSNSASLTISGLKTEDE ADYYCQSYDINSRWVFGGGTKLTVL | 1464 | QSY DIN SR WV |
| COVD57_P1_L_F10-1409 | 1467 | QSVLTQPPSVSGAPGQRVTISCTGSNSNI GAGYDVHWYQQLPGTAPKLLIYGNSNR PSGVPDRFSGSKSGTSASLAITGLQAEDE ADYYCQSYDSSLSGSRVFGGGTKLTVL | 1468 | QSY DSS LSG SRV |
| COVD57_P1_L_H3-1409 | 1471 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLSGSRVFGGGTKLTVL | 1472 | QSY DSS LSG SRV |
| COVD57_P1_L_A5-1409 | 1475 | QSVLTQPASVSGSPGQSITISCTGTSSDV GGYNYVSWYQQHPGKAPKLMIYDVSN RPSGVSNRFSGSKSGNTASLTISGLQAED EADYYCSSYTPNSTLVVFGGGTKLTVL | 1476 | SSY TPN STL W |

TABLE 10-continued

Anti-SARS-CoV-2 IgG antibodies from COV57

| | | | | |
|---|---|---|---|---|
| COVD57_P1_L_A9-1409 | 1479 | QSVLTQPPSASGSPGQSVTISCTGTRSDVGGYNYVSWYQQHPGKAPKLIIYEVTKRPSGVPDRFSGSKSGDTASLTVSGLQADDEADYFCSSYAGITNLVFGGGTKLTV | 1480 | SSY AGI TNL V |
| COVD57_P1_L_A11-1409 | 1483 | QSVLTQPPSASGSPGQSVTISCTGTSSDVGGYNYVSWYQHHPGKAPKLMIFEVTKRPSGVPDRFSGSKSGNTASLTVSGLQAEDEADYYCSYGGNNNAVFGGGTKLTVL | 1484 | YSY GG NN NAV |
| COVD57_P2_L_B1-1409 | 1487 | QSVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGSVFGTVTKVTVL | 1488 | QSY DSS LSG SV |
| KAPPA | | | | |
| COVD57_P1_K_F11-1389 | 1491 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK | 1492 | MQ ALQ TPP T |
| COVD57_P2_K_G11-1389 | 1495 | EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGGGTKVEIK | 1496 | QQY NN WP RT |
| COVD57_P2_K_C12-1389 | 1499 | DIQMTQSPSSLSASVGDRVXITCRASQSISSYLNWYQQKPGKAPKLLIYAASSLQSGVPSRFSGSGSGTDFTLTISSLQPEDFATYYCQQSYSTPPWTFGQGTKVEIK | 1500 | QQS YST PP WT |
| COVD57_P2_K_C3-1389 | 1503 | EIVLTQSPXSLSLSPGERATLSCGASQSVSSSYLAWYQQKPGLAPRLLIYDASSRATGIPDRFSGSGSGTDFTLTISRLEPEDFAVYYCQQYGSSPYTFGQGTKLEIK | 1504 | QQY GSS PYT |
| COVD57_P2_K_E11-1389 | 1507 | EIVMTQSPATLSLSPGERATLSCRASQSVSSNLAWYHQKPGQAPRLLIYGASTRATGIPARFSGSGSGTEFTLTISSLQSEDFAVYYCQQYDNWPLFGQGTRLEIK | 1508 | QQY DN WPL |
| LAMBDA | | | | |
| COVD57_P2_L_H12-1409 | 1511 | QSVLTQPPSVSGAPGQRVTISCTGSSNIGAGSDVHWYQKLPGTAPKVFIYGYNNRPSGVPDRFSGSKSGTSASLAITGLQAEDEADYYCQSYDTSLRVVFGGGTKLTV | 1512 | QSY DTS LRV V |
| COVD57_P2_L_H12-1409 | 1515 | QSVLTQPPSVSGAPGQRVTISCTGSSNIGAGSDVHWYQKLPGTAPKVFIYGYNNRPSGVPDRFSGSKSGTSASLAITGLQAEDEADYYCQSYDTSLRVVFGGGTKLTV | 1516 | QSY DTS LRV V |
| KAPPA | | | | |
| COVD57_P1_K_B8-1389 | 1519 | DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPYTFGQGTKLEIK | 1520 | MQ SIQL PYT |
| LAMBDA | | | | |
| COVD57_P2_L_C2-1409 | 1523 | SYVLTQPPSVSVAPGQTARITCGGNNIGSKSVHWYQQKPGQAPVLVVYDDSDRPSGIPERFSGSNSGDTATLTISRVEAGDEADYYCQVWDSSSDPHYVFGTGTKVTV | 1524 | QV WD SSS DPH YV |
| COVD57_P1_L_C8-1409 | 1527 | SYVLTQPPSVSVAPGQTARITCGGNNIGSKNVHWYQQKPGQAPVLVVYDDSDRPSGIPERFSGSNSGNTATLTISRVEAGDEADYYCQVWDSSSDPHWVFGGGTKLTVL | 1528 | QV WD SSS DPH WV |

TABLE 10-continued

Anti-SARS-CoV-2 IgG antibodies from COV57

KAPPA

| SEQUENCE_ID | SEQ ID NO | aa | SEQ ID NO | cdr3_aa |
|---|---|---|---|---|
| COVD57_P1_K_F9-1389 | 1531 | DIQLTQSPSFLSASVGDRVTITCRASQGIS SYLAWYQQKPGKAPKLLIYAASTLQSGV PSRFSGSGSGTEFTLTISSLQPEDFATYYC QQLNSYPPVTFGQGTRLEIK | 1532 | QQL NSY PPV T |
| COVD57_P1_K_C3-1389 | 1535 | DIQMTQSPSSLSASVGDRVTITCQASQD ISNYLNWYQQKPGKAPKLLIYDASNLET GVPSRFSGSGSGTDFTFTISSLQPEDIATY YCQQYDNLPRTFGQGTKVEIK | 1536 | QQY DNL PRT |
| COVD57_P1_K_G3-1389 | 1539 | DIQMTQSPSSLSASVGDRVTITCRASQSII NYLNWYQQKPGKAPKLLIYTASSLQSGV PSRFSGSGSGTDFTLTISSLQPEDFATYFC QQSYSSPLWTFGQGTKVEIK | 1540 | QQS YSS PLW T |
| COVD57_P2_K_B7-1389 | 1543 | EIVMTQSPATLSVSPGERATLSCRASQSV SSNLAWYHQKPGQAPRLLIYGASTRATG IPARFSGSGSGTEFTLTISSLQSEDFAVYY CQQYDNWPLFGQGTRLEIK | 1544 | QQY DN WPL |
| COVD57_P1_K_H10-1389 | 1547 | DIQMTQSPSSLSASVGDRVTITCRASQSI STYLNWYQQKPGKAPELLIYAASSFQSG VPSRFSGSGSGTDFTLTIRSLEPEDSATYY CQQSYTTPYTFGQGTKLEIK | 1548 | QQS YTT PYT |
| COVD57_P1_K_B9-1389 | 1551 | DIQMTQSPSSLSASVGDRVTITCRASQSI SSYLNWYQQKPGKAPKLLIYAASSLQSG VPSRFSGSGSGTDFTLTISSLQPEDFATYY CQQSYSTPRTFGQGTKVEIK | 1552 | QQS YST PRT |
| COVD57_P2_K_E3-1389 | 1555 | EIVLTQSPATLSLSPGERATLSCRASQSVS NYLAWYQQKPGQAPRLLISDASNRATG VPDRFSGSGSGTDFTLTINSLEPEDFAVY YCQQGDNWPRMYTFGQGTKLQIK | 1556 | GD NW PR MYT |

LAMBDA

| COVD57_P2_L_F8-1409 | 1559 | QSVLTQPPSVSAAPGQKVTISCSGSSSNI GNNYVSWYQQLPGTAPKLLIYDNNKRP SGIPDRFSGSKSGTSATLGITGLQTGDEA DYYCGTWDSSLSAYWVFGGGTKLTVL | 1560 | WD SSLS AY WV |
| COVD57_P2_L_H11-1409 | 1563 | SYVLTQPPSVSVSPGQTASITCSGDKLGD KYACWYQQKPGQSPVLVIYQDSKRPSGI PERFSGSNSGNTATLTISGTQAMDEADY YCQAWDSSTAYVFGTGTKVTVL | 1564 | QA WD SST AYV |
| COVD57_P2_L_A9-1409 | 1567 | QSVLTQPASVSGSPGQSITISCTGTSSDIG VYNYISWSQHPGKAPKVMIYDVTNRP SGVSNRFSGSKSGNTASLTISGLQAEDEA DYYCSSYRGSSTPYVFGTGTKVTVL | 1568 | SSY RGS STP YV |

TABLE 11

Anti-SARS-CoV-2 IgG antibodies from COV72

| SEQUENCE_ID | SEQ ID NO | aa | SEQ ID NO | cdr3_aa |
|---|---|---|---|---|

HEAVY

| COV072_P3_HC_50-P1369 | 1733 | EVQLLESGGGLVQPGGSLRLSCAASGFTFSTYA MSWVRQAPGKGLEWVSTITGSGGFTYYADSV KGRFTISRDNSKNTLFLQMNSLRAEDAAVYYCA NHPLASGDEYYYYYMDVWGKGTTVTVSS | 1734 | ANHPLA SGDEYY YYYMDV |
| COV072_Plate2_HC_24-P1369 | 1737 | EVQLLESGGGLVQPGGSLRLSCAASGFTFSTYA MSWVRQAPGKGLEWVSTITGSGRDTYYADSV KGRFTISRDNSKNTLFLQLNSLRAEDAAVYSCAN HPLASGDDYYHYYMDVWGKGTTVTVSS | 1738 | ANHPLA SGDDYY HYYMD V |

TABLE 11-continued

Anti-SARS-CoV-2 IgG antibodies from COV72

| | | | | |
|---|---|---|---|---|
| COV072_Plate2_HC_66-P1369 | 1741 | EVQLLESGGGLVQPGGSLRLSCVASRFTFSNYAMSWVRQAPGKGLEWVSTITGTGDHTYYADSVKGRFTISRDNSKNTLYLQMNSLRAEDTAIFYCANSPCSSASCKSGYYYYMDVWGKGTTVTVSS | 1742 | ANSPCSSASCKSGYYYYYMDV |
| COV072_P3_HC_17-P1369 | 1745 | QVQLVQSGSEVKKPGSSVKVSCKASGGTFSSYAFSWVRQAPGQGLEWIVIGRIIPILALANYAQKFQGRVTITADKSTSTAYMELSSLRSEDTAVYYCARVNQAVTTPFSMDVWGQGTTVTVSS | 1746 | ARVNQAVTTPFSMDV |
| COV072_P3_HC_21-P1369 | 1749 | QVQLVQSGAEVKKPGSSVKVSCKASGDTFSSSALSWVRQAPGQGLEWIVIGRIIPILGITNYAQKFQGRVTITADKSTSTAYMELNSLRSEDTAVYYCARANQPVTTPFSMDVWGQGTTVTVSS | 1750 | ARANQPVTTPFSMDV |
| COV072_P3_HC_53-P1369 | 1753 | QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDSDVDTSMVTWFDYWGQGTLVTVSS | 1754 | ARDSDVDTSMVTWFDY |
| COV072_Plate2_HC_83-P1369 | 1757 | QVQLVESGGGVVQPGRSLRLSCAASGFTFSTYAMHWVRQAPGKGLEWVAVISYDGTNKFYADSVKGRFTISRDNSKNTLYLQMNSLRAEDTAVFYCARDSDVDTAMVTWFDYWGQGTLVTVSS | 1758 | ARDSDVDTAMVTWFDY |
| COV072_P3_HC_80-P1369 | 1761 | EVQLVESGGGLVQPGGSLRLSCAASGITVSSNYMSWVRQAPGKGLEWVSVIYSGGSTYYADSVKGRVTISRDNSKNTLYLQMNSLRVEDTAVYYCARDLGDYGMDVWGQGTTVTVSS | 1762 | ARDLGDYGMDV |
| COV072_Plate2_HC_36-P1369 | 1765 | EVQLVESGGGLVQPGGSLRLSCAASGVTVSSNYMSWVRQAPGKGLEWVSLIYSGGSTFYADSVKGRFTISRDNSENTLYLQMNTLRAEDTAVYYCARDLYYYGMDVWGQGTTVTVSS | 1766 | ARDLYYYGMDV |
| COV072_P3_HC_49-P1369 | 1769 | QVQLVQSGAEVKKPGASVKVSCKASGYTFTNYYMHWVRQAPGQGLEWMGIINPSGGSTGYAQKFQGRVTMTRDTSTSTVYMELSSLRSEDTAVYYCARSRPTPDWYFDLWGRGTLVTVSS | 1770 | ARSRPTPDWYFDL |
| COV072_Plate2_HC_81-P1369 | 1773 | QVQLVQSGAEVKKPGASVKVSCKASGYTFTSHYIHWVRQAPGQGLEWMGIINPSGGSTSYAQKFQGRVTMTRDTSTTTLYMDLSSLRSEDTAVYYCAKSRPTPDWYFDLWGRGTLVTVSS | 1774 | AKSRPTPDWYFDL |
| COV072_P3_HC_51-P1369 | 1777 | EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS | 1778 | AKDPLITGPTYQYFHY |
| COV072_Plate2_HC_93-P1369 | 1781 | EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS | 1782 | AKDPLITGPTYQYFHY |
| COV072_P3_HC_12-P1369 | 1785 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARALQGPWLGADYWGQGTLVTVSS | 1786 | ARALQGPWLGADY |
| COV072_Plate2_HC_33-P1369 | 1789 | EVQLVESGGGLVQPGGSLRLSCAASGFTFSTYWMSWVRQPPGKGLEWVANIKQDGSEKYYVDSVKGRFTISRDNAKNSLYLQMNSLRADDTAVYYCAGGTWLRSSFDYWGQGTLVTVSS | 1790 | AGGTWLRSSFDY |
| COV072_P3_HC_25-P1369 | 1793 | QVQLQESGPGLVKPSGTLSLTCAVSGGSISSNNWWSCVRQPPGKGLEWIGEIYHSGSTNYNPSLKSRVTISVDKSKNQFSLKLSSVTAADTAVYYCARGGDTAMGPEYFDYWGQGTLVTVSS | 1794 | ARGGDTAMGPEYFDY |
| COV072_Plate2_HC_53-P1369 | 1797 | QVQLQESGPGLVKPSGTLSLTCAVSGGSISSNNWWSWVRQPPGKGLEWIGEIYHSGSTNYNPSLKSRVTISVDKSKNQFSLKLSSVTAADTAVYYCAKGGDRAMGPEYFDYWGQGTLVTVSS | 1798 | AKGGDRAMGPEYFDY |

TABLE 11-continued

Anti-SARS-CoV-2 IgG antibodies from COV72

| | | | | |
|---|---|---|---|---|
| COV072_P3_HC_44-P1369 | 1801 | QVQLVQSGAEVKKPGASVKVSCKASGYTFTSYG ISWVRQAPGQGLEWMGWISAYNGNTKYAQK LQGRVTMTTDTSTSTAYMELRSLRSDDTAVYFC ARVLGIIVAGSLNWGQGTLVTVSS | 1802 | ARVLGII VAGSLN |
| COV072_P3_HC_40-P1369 | 1805 | QVQLVQSGAEVKKPGASVKVSCKASGYTFSSNY MHWVRQAPGQGLEWMGIINPSGGSTTYAQK FQGRVTMTRDTSTSTVYMELSSLRSEDTAVYYC ARDLGYIPASDAFDIWGQGTMVTVS | 1806 | ARDLGY IPASDAF DI |
| COV072_P3_HC_77-P1369 | 1809 | QVQLVQSGAEVKKPGSSVKVSCKASGGTFSSYT ISWVRQAPGHGLEWMGRIIPILGIANYAQKFQ GRVTITADKSTSTAYMELSSLRSEDTAVYYCARF SNYCTSTSCYDYWGQGTLVTVSS | 1810 | ARFSNY CTSTSCY DY |
| COV072_Plate2_HC_9-P1369 | 1813 | QVQLVQSGAEVKKPGASVKVSCKASGYTFTSYG ISWVRQAPGQGLEWMGWISAYNGNTNYAQK LQGRVTMTTDTSTSTAYMELRSLRSDDTAVYYC ARDGITGTIEYYFDYWGQGTLVTVSS | 1814 | ARDGIT GTIEYYF DY |
| COV072_P3_HC_34-P1369 | 1817 | QVQLVQSGAEVKKPGASVKVSCKVSGYTLTELS MHWVRQAPGKGLEWIVIGGFDPEDGETIYVQK FQGRATMTEHTSTETAYMELSSLRSEDTAVYYC ATNAEIAARKGGMDVWGQGTVTVSS | 1818 | ATNAEI AARKGG MDV |
| COV072_P3_HC_10-P1369 | 1821 | QVQLVQSGAEVKKPGASVKVSCKASGYTFTSYY IHWVRQAPGQGLEWMGIINPSAGSTSYAQKF QGRVTMTRDTSTSTVYMELSSLRSEDTAVYYCA RDIALVPAAMGLDYWGQGTLVTVSS | 1822 | ARDIAL VPAAM GLDY |
| COV072_P3_HC_42-P1369 | 1825 | QMQLVQSGPEVKKPGTSVKVSCKASGFTFTNS AVQWVRQSRRQRLEWIGWIVVGSGNTNYAQ KFQERVTITRDMSTSTAYMELSSLRSEDTAVYYC AAVDCNSTSCYDAFDIWGQGTMVTVSS | 1826 | AAVDC NSTSCY DAFDI |
| COV072_P3_HC_31-P1369 | 1829 | QVQLVQSGAEVKKPGSSVKVSCKASGGTVNNY AINWVRQAPGQGLEWMGGIVPIFGTPNYAQK FQGRVTITADESTSTAYMELSSLRSEDTAVYYCA KVSLTLPIAAAPRFWFDSWGQGTLVTVSS | 1830 | AKVSLTL PIAAAP RFWFDS |
| COV072_P3_HC_30-P1369 | 1833 | QVQLVQSGAEVKKPGSSVKVSCKASGGTFSSYA ISWVRQAPGQGLEWMGRIIPMLVIATYARKFQ GRVTITADKSTSTAYMELSSLRSEDTAVYYCARG VVAATPGNFDIWGQGTMVTVSS | 1834 | ARGWA ATPGNF DI |
| COV072_P3_HC_48-P1369 | 1837 | QVQLVQSGAEVKKPGSSVKVSCKASGGTFSSYA INWVRQAPGQGLEWMGRIIPIVGIANYAQKFQ GRVTITADKSSSTAYMELSSLRSEDTAVYYCARD LLDPQLDDAFDIWGQGTMVTVSS | 1838 | ARDLLD PQLDDA FDI |
| COV072_Plate2_HC_40-P1369 | 1841 | QVQLVQSGAEVKKPGSSVKVSCKASGGTFSSYA INWVRQAPGQGLEWMGRIIPILDISNYAQKFQ GRVTITADKSTSIAYMELSSLRSEDTAVYYCARG GYSYGQLYYFDYWGQGTLVTVSS | 1842 | ARGGYS YGQLYY FDY |
| COV072_P3_HC_58-P1369 | 1845 | QVQLVESGGGLVKPGGSLRLSCAASGFTFSHYN MIWIRQAPGKGLEWVSYISSSSSYTNCSDSVRG RFTISRDNAKNSLYLQMNSLRAEDTAVYYCARD RGYSGYGLDRFDYWGQGTLVTVSS | 1846 | ARDRGY SGYGLD RFDY |
| COV072_P3_HC_64-P1369 | 1849 | QVQLVESGGGLVKPGGSLRLSCAASGFTFSDYY MTWIRQAPGKGLEWVSYITTSSSYTNYADSVK GRFTISRDNAKNSLYLQMNSLRAEDTAVYYCAR DNITMVRGVIVRPNDGGYYYALDVWGQGTTV TVSS | 1850 | ARDNIT MVRGVI VRPND GGYYYA LDV |
| COV072_P3_HC_5-P1369 | 1853 | EVQLLESGGGLVQPGGSLRLSCTASGFTFSTYA MSWVRQAPGKGLEWVSAISDSGGSTYYADSV KGRFTISRDNSKNTLYLQMNSLRAEDTAVYYCA KSKTVERLPYCGGDCFSAIDYWGQGTLVTVSS | 1854 | AKSKTV ERLPYC GGDCFS AIDY |
| COV072_Plate2_HC_92-P1369 | 1857 | EVQLLESGGGLVQPGGSLRLSCAASGFTFSSYA MSWVRQAPGKGLEWISAISGSGGRTYNADSV KGRFTISRDNSKNTLYLQMNSLRAEDTAVYYCA KAGPAAAYGWYYYMDVWGKGTTVTASS | 1858 | AKAGPA AAYGW YYYYMD V |

TABLE 11-continued

Anti-SARS-CoV-2 IgG antibodies from COV72

| | | | | |
|---|---|---|---|---|
| COV072_Plate2_HC_15-P1369 | 1861 | QVQLVESGGGVVQPGRSLRLSCAASGFTFSSYAMHWVRQAPGKGLEWVAVISYDGTDSVKGRFTISRDTSKNMLYLQMNSLRAEDTAVYYCAKGPRFGWSYRGGPGFDIWGQGTMVTVSS | 1862 | AKGPRFGWSYRGGPGFDI |
| COV072_P3_HC_45-P1369 | 1865 | QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSS | 1866 | ASSSGYLFHSDYAKGPRF |
| COV072_Plate2_HC_31-P1369 | 1869 | QVQLVESGGGVVQPGRSLRLSCAASGFTFSSYGMNWVRQAPGKGLEWVAVISYDGSNTYYTDSVKGRFTISRDNSKNTLYLQMNSLRVDDTATYYCAKGPRFGWSYRGGSGFDIWGQGTMVTVSS | 1870 | GWSYRGGSGFDI |
| COV072_P3_HC_3-P1369 | 1873 | QVQLVESGGGVVQPGRSLRLSCAVSGFTFSSYGMHWVRQAPGKGLEWVAVISYDGSNKHYADSVKGRFTISRDNSKNTLYVQMNSLRAEDTAMYYCAKQLGLYCSGGNCYSGALDYWGQGTLVTVSS | 1874 | AKQLGLYCSGGNCYSGALDY |
| COV072_P3_HC_37-P1369 | 1877 | QVQLVESGGGVVQPGRSLRLSCAASGFTFSSYGMHWVRQAPGKGLEWVAVISYDGSNKYYADSVKGRFTISRDNSKNMLYLQMNSLRAEDTAVYYCAKQNGLYCSGGSCYLGYFDYWGQGTLVTVSS | 1878 | AKQNGLYCSGGSCYLGYFDY |
| COV072_Plate2_HC_63-P1369 | 1881 | QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS | 1882 | AKGGAYSYYYYMDV |
| COV072_P3_HC_69-P1369 | 1885 | QVQLVESGGGVVQPGRSLRLSCAASGFTFSSYTMHWVRQAPGKGLEWVAVISYDGSIKYYADSVKGRFTISRDNSKNTLYLQMNSLRAEDTAVYYCARDSDTAMVDYFDYWGQGTLVTVSS | 1886 | ARDSDTAMVDYFDY |
| COV072_P3_HC_74-P1369 | 1889 | QVQLVESGGGVVQPGRSLRLSCAASGFTFSSYAMHWVRQAPGKGLEWVAVISYDGSNKYYADSVKGRCTISRDNSKNTLFLQMNSLRPEDTAVYYCAKVDLKYSYGLYYFDYWGQGTLVTVSS | 1890 | AKVDLKYSYGLYYFDY |
| COV072_Plate2_HC_12-P1369 | 1893 | QVQLVESGGGVVQPGRSLRLSCAASGFTFSHYAMHWVRQAPGKGLEWVAVIPFDGSNKYYADSVKGRFTISRDNSKNTLYLQMNSLRAEDTAVYYCASSSGYLFHFDYWGQGTLVTVSS | 1894 | ASSSGYLFHFDY |
| COV072_Plate2_HC_23-P1369 | 1897 | QVQLVESGGGVVQPGRSLRLSCAASGFTFSNYAMHWVRQAPGKGLEWVAVISYDGSKKYSADSVKGRFTISRDNSKNTLYLQMNSLRPVDTAVYYCARVRLGAYYNYFGMDVWGQGTTVTVSS | 1898 | ARVRLGAYYNYFGMDV |
| COV072_P3_HC_68-P1369 | 1901 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKKGQPYCGGDCYFYYFDYWGQGTLVTVSS | 1902 | AKKGQPYCGGDCYFYYFDY |
| COV072_Plate2_HC_72-P1369 | 1905 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGTGIAAAGTANPPFDYWGQGTLVTVSS | 1906 | ARDGTGIAAAGTANPPFDY |
| COV072_Plate2_HC_25-P1369 | 1909 | QVQLVESGGGVVQPGRSLRLSCAASGFTFSTYGMHWVRQAPGKGLEWVAVIWYDGNNKYYADSVKGRFTISRDNSKNTLYLQMNSLRAEDTAVYYCATSLFGIISLDYWGQGTLVTVSS | 1910 | ATSLFGIISLDY |
| COV072_Plate2_HC_54-P1369 | 1913 | QVQLVESGGGVVQPGRSLRLSCAASGFTFNNYGMHWVRQAPGKGLEWVAVIWYDGSNKYYADSVKGRFTISRDNSKNTVYLQMNSLRAEDTAVYYCARDWEIVVAGMDVWGQGTTVTVSS | 1914 | ARDWEIVVAGMDV |
| COV072_Plate2_HC_78-P1369 | 1917 | EVQLVESGGVVVQPGGSLRLSCAASGFTFDDHTMHWVRQAPGKGLEWVSLISWDAGSTYYADSVKGRFTISRDNRKNFLYLQMNSLRTEDTALYYCAKGLNYRPQYYYYYGMDVWGQGTTVTVSS | 1918 | AKGLNYRPQYYYYYGMDV |

TABLE 11-continued

Anti-SARS-CoV-2 IgG antibodies from COV72

| | | | | |
|---|---|---|---|---|
| COV072_P3_HC_26-P1369 | 1921 | EVQLVESGGGLIQPGGSLRLSCAASGFTVSSNYMSWVRQAPGKGLEWISVIYSGGSTFYADSVKGRFTISRDNSKDTLYLQMNRLRAEDTAVYYCARSFYFDAFDIWGQGTMVTVSS | 1922 | ARSFYFDAFDI |
| COV072_P3_HC_67-P1369 | 1925 | EVQLVESGGGLIQPGGSLRLSCAASGFIVSRNYMSWVRQAPGKGLEWVSVIYSGGSTYYADSVKGRFTISRDNSKNTLYLQMNSLRADDTAVYYCTRDPVPGRGDAYWGQGTLVTVSS | 1926 | TRDPVPGRGDAY |
| COV072_Plate2_HC_89-P1369 | 1929 | EVQLVETGGGLIQPGGSLRLSCAASGITVSSNYMSWVRQAPGKGLEWVSIYSGGSTFYADSVKGRFTISRDNPKNTLYLQMNSLRAEDTAVYYCARDLYYYGMDVWGQGTTVTVS | 1930 | ARDLYYYGMDV |
| COV072_P3_HC_22-P1369 | 1933 | EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKDITMIVDVFEYWGQGTLVTVSS | 1934 | VKDITMIVDVFEY |
| COV072_P3_HC_47-P1369 | 1937 | EVQLVESGGGLVQPGGSLRLSCAASEFIVSRNYMSWVRQAPGKGLEWVSLIYSGGSTYYADSVKGRFTISRDNSKNTLYLQMNSLRAEDTAMYYCARDIAGRLDYWGQGTLVTVSS | 1938 | ARDIAGRLDY |
| COV072_P3_HC_59-P1369 | 1941 | EVQLVESGGGLVQPGGSLRLSCAASGFIVSSNYMSWVRQAPGKGLEWVSILYSGGSTYYADSVKGRFTISRDNSKNTLYLQMNSLRAEDTAVYYCARDLVVYGADYWGQGTLVTVSS | 1942 | ARDLWYGADY |
| COV072_Plate2_HC_16-P1369 | 1945 | EVQLVESGGDLVQPGGSLRLSCAASGLTVSSNYMSWVRQAPGKGLEWVSVIYSGGSTFYADSVKGRFTISRDNSQNTLYLQMNSLRAEDTAVYYCARDLQYYGMDVWGQGTTVTVSS | 1946 | ARDLOYYGMDV |
| COV072_Plate2_HC_37-P1369 | 1949 | EVQLVESGGGLVQPGGSLRLSCAASGFTFSSYWMSWVRQAPGKGLEWVANIKQDGSVKYYVDSVKGRFTISRDNAKNSLYLQMNSLRDEDTAVYYCARDQVSWYNLDAFDIWGQGTMVTVSS | 1950 | ARDQVSWYNLDAFDI |
| COV072_Plate2_HC_86-P1369 | 1953 | QVQLQESGPGLVKPSQTLSLTCTVSGGSISSGDYSWSWIRQPPGKGLEWIGYIYYSGSTYYNPSLKSRVTISVDTSKNQFSLKLSSVTAADTAVYYCVRVVMSGIAAAGQNDYWGQGTLVTVSS | 1954 | VRWMSGIAAAGQNDY |
| COV072_Plate2_HC_32-P1369 | 1957 | QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARTYYYDSSGYYFQYYFDCWGQGTLVTVSS | 1958 | ARTYYYDSSGYYFQYYFDC |
| COV072_Plate2_HC_67-P1369 | 1961 | QVQLQESGPGLVKPSQTLSLTCTVSGGSISSGGYYWSWIRQHPGKGLEWIGYIYYSGSTYYNPSLKSRVTISVDTSKKQFSLKLSSVTAADTAVYYCATNYDDYVPAEYFQDWGQGTLVTVSS | 1962 | ATNYDDYVPAEYFQD |
| COV072_Plate2_HC_88-P1369 | 1965 | QVQLQESGPGLVKPSQTLSLTCTFSGGSISSGGHYWSWIRQHPGKGLEWIGYIYYSGSTYYNPSLKSRVIISVDTSKNQFSLRLSSVTAADTAVYYCARSCSSTSCPFDYWGQGTLVTVSS | 1966 | ARSCSSTSCPFDY |
| COV072_Plate2_HC_74-P1369 | 1969 | QLQLQESGPGLVKPSETLSLTCTVSGGSISSSSYYWGWIRQSPGKGLEWIGSIYYSGSTYYNPSLKSRVTISVDTSKNQFSLKLSSVTAADTAVYYCARRPPGDYYYMDVWGKGTTVTVSS | 1970 | ARRPPGDYYYMDV |
| COV072_P3_HC_4-P1369 | 1973 | QVQLQQSGPGLVKPSQTLSLTCAISGDSVSSNSTAWNWIRQSPSRGLEWLGRTYYRSKWYNHYALSVKSRITINPDTSKNQFSLQLNSVTPEDTAVYYCARSGSYYISHGMDVWGQGTTVTVSS | 1974 | ARSGSYYISHGMDV |
| COV072_P3_HC_54-P1369 | 1977 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNDGSSGWYPERGGGFDYWGQGTLVTVSS | 1978 | ARNDGSSGWYPERGGGFDY |

TABLE 11-continued

Anti-SARS-CoV-2 IgG antibodies from COV72

| | | | | |
|---|---|---|---|---|
| COV072_P3_HC_94-P1369 | 1981 | QVQLVESGGGVVQPGRSLRLSCAASGFTFSSYAIHWVRQAPGKGLEWVAVISNDGSNKYYEDSVKGRFTFSRDNSKNTLYLQMNSLRAEDTAVYYCARALSFIAVAGIDYWGRGTLVTVSS | 1982 | ARALSFIAVAGIDY |
| COV072_P3_HC_91-P1369 | 1985 | QVQLVESGGGVVQPGRSLRLSCAASGFTFSSYAMFWVRQAPGKGLEWVAVISYDGSNKYYADSVKGRFTISRDNSKNTLYLQI\/INSLRAEDTAVYYCARADLGYCTNGVCYVDYWGQGTLVTVSS | 1986 | ARADLGYCTNGVCYVDY |
| COV072_Plate2_HC_14-P1369 | 1989 | EVQLVESGGGLVQPGGSLRLSCAASGFTVSSNYMSWVRQAPGKGLEWVSVIYSGGSTYYADSVKGRFTISRDNSKNTLYLHMNSLRAEDTAVFYCASHLMPDAFDIWGQGTMVTVSS | 1990 | ASHLMPDAFDI |
| COV072_P3_HC_1-P1369 | 1993 | EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARVVGYDFWSGYDGGYFDYWGQGTLVTVSS | 1994 | ARWGYDFWSGYDGGYFDY |
| COV072_P3_HC_71-P1369 | 1997 | QVQLVESGGGVVQPGRSLRLSCVASGFTFSSYGMHWVRQAPGKGLEWVAVIWYDGSNKYYADSVKGRFTISRDNSKNTLYLKMNSLRAEDTAVYYCARGEWDSGSYQYYDYYMDVWGKGTTVTVSS | 1998 | ARGEWDSGSYQYYDYYMDV |
| COV072_Plate2_HC_5-P1369 | 2001 | EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTGRITFGGGDDAFDIWGQGTMVTVSS | 2002 | ARDTGRITFGGGDDAFDI |
| COV072_Plate2_HC_71-P1369 | 2005 | QVQLQESGPGLVKPSQTLSLTCTVSGGSISSGGYYWNWIRQHPGKGLEWIGYIYYSGSTYYNPSLKSRVTISVDTSQNQFSLRLSSVTAADTAVYYCARGVVLITDYYFDYWGQGTLVTVSS | 2006 | ARGVVLITDYYFDY |
| COV072_P3_HC_73-P1369 | 2009 | QVQLQQWGAGLLKPSETLSLTCAVYGGSFSAYSWSWIRQPPGKGLEWIGEINHGGSTNYNASLKSRVTISADTSKNLFSLKLSSVTAADTAVYYCAREGAVAGGDFDYWGQGTLVTVSS | 2010 | AREGAVAGGDFDY |
| COV072_Plate2_HC_76-P1369 | 2013 | QVQLQESG PG LVKPS ETLS LTCTVSGGS1SSYYWSWIRQPPGKGLEWIGYIYYSGSTRYNPSLKSRVTISVDTSKNQFSLKLSSVTAADTAVFYCARGRGLPPWFDPWGQGTLVTVSS | 2014 | ARGRGLPPWFDP |
| COV072_P3_HC_18-P1369 | 2017 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARPDMSSSSSPHYWYFDLWGRGTLVTVSS | 2018 | ARPDMSSSSSPHYWYFDL |
| COV072_P3_HC_84-P1369 | 2021 | EVQLVQSGAEVKKPGESLKISCKGSGYSFTSYWIVWVRQMPGKGLERMGIIYPGDSDTRYSPSFQGQVTISADKSISTAYLQWSSLKASDTAMYYCARRGGSYYNNGDGMDVWGQGTTVTVSS | 2022 | ARRGGSYYNNGDGMDV |
| COV072_P3_HC_55-P1369 | 2025 | EVQLVESGGGLVKPGGSLRLSCAAASGFTISNAWMSWVRQAPGKGLEWVGRIKSKTDGGTTDYAAPVKGRFTISRDNSKNTLYLQMNSLKTEDTAVYYCTTDYSIRYYYGMDVWGQGTTVTVSS | 2026 | TTDYSIRYYYGMDV |
| COV072_P3_HC_38-P1369 | 2029 | EVQLVESGGGLVKPGGSLRLSCAASGFTFSTYSMNWVRQAPGKGLEWVSSISSSSNYIYYADSVKGRFTISRDNAKNSLYLQMNSLRAEDTAVYYCARAKLEIAHYGGSPGFDYWGQGTLVTVSS | 2030 | ARAKLEIAHYGGSPGFDY |
| COV072_P3_HC_36-P1369 | 2033 | EVQLVESGGGLVKPGGSLRLSCAASGFSFRSYSMNWVRQAPGKGLEWVSSISSSSYIYYADSVKGRFTISRDNAKNSLYLQMNSLRAEDTAVYYCARMGLELPGLDYGMDVWGQGTTVTVSS | 2034 | ARMGLELPGLDYGMDV |
| COV072_Plate2_HC_94-P1369 | 2037 | EVQLLESGGGLVQPGGSLRLSCAASGFTFSTYAMTWVRQAPGKGLEWVSAISGSGGRTYYADSVKGRFTISRDNSKNTLYLQMNSLRAEDTAVYYCAKVDYGEYVFSNAFDIWGQGTMVSVSS | 2038 | AKVDYGEYVFSNAFDI |

TABLE 11-continued

Anti-SARS-CoV-2 IgG antibodies from COV72

| SEQUENCE_ID | SEQ ID NO | aa | SEQ ID NO | cdr3_aa |
|---|---|---|---|---|
| COV072_P3_HC_56-P1369 | 2041 | QVQLVESGGGVVQPGRSLRLSCAASGFTFSNYGMHWVRQAPGKGLEWVAVLSYEGSSTYYADSVKGRFTISRDNSKNTLYLQMNSLRAEDTAVYYCAKAGGRDYYDSSGYYLLDHYYGMDVWGQGTTVTVSS | 2042 | AKAGGRDYYDSSGYYLLDHYYGMDV |

| SEQUENCE_ID | SEQ ID NO | aa | SEQ ID NO | cdr3_aa |
|---|---|---|---|---|
| | | KAPPA | | |
| COV072_Plate3_Kappa_50-P1389 | 1735 | EIVLTQSPGTLSLSPGERATLSCRASQSVNSRQLAWYQQKPGQGPRLLIYGASSRATGIPDRFSGSGSGTDFTLTISRLEPEDFAVYYCQQYGSSRALTFGGGTKVEIK | 1736 | QQYGSSRALT |
| COV072_Plate2_Kappa_24-P1389 | 1739 | EIVLTQSPGTLSLSPGERATLSCRASQSVNSRQLAWYQQKPGQAPRLLIYGASSRATGIPERFSGSGSGTDFTLTISRLESEDFAVYHCQQYGSSRALTFGGGTKVEIK | 1740 | QQYGSSRALT |
| COV072_Plate2_Kappa_66-P1389 | 1743 | EIVLTQSPGTLSLSPGERATLFCRASQSVTSSHLAWYQQKAGQAPRLLIYGASSRATGIPDRFSGSGSGTDFTLTISRLEPEDFAVYYCQQYGSSRSLTFGGGTKVEIK | 1744 | QQYGSSRSLT |
| COV072_Plate3_Kappa_17-P1389 | 1747 | EIVMTQSPATLSVSPGERATLSCRASQSVSSNLAWYQQKPGQAPRLLIYGASTRATGIPARFSGSGSGTEFTLTISSLQSEDFAVYYCQQYNNWPITFGQGTRLEIK | 1748 | QQYNNWPIT |
| COV072_Plate3_Kappa_21-P1389 | 1751 | EIVMTQSPATLSVSPGERATLSCRASQSVSSNLAWYQQKPGQAPRLLIYAASTRATGIPARFSGSGSGTEFTLTISSLQSEDFAVYYCQQYNNWPITFGQGTRLEIK | 1752 | QQYNNWPIT |
| COV072_Plate3_Kappa_53-P1389 | 1755 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 1756 | QQSYSTPPWT |
| COV072_Plate2_Kappa_83-P1389 | 1759 | DIQMTQSPSSLSASVGDRVTITCRASQSISSYLNWYQHKPGKAPKLLIYASSSLQSGVPSRFSGSGSGTDFTLTISSLQPEDFATYYCQQSYSTPPWTFGQGTKVEIK | 1760 | QQSYSTPPWT |
| COV072_Plate3_Kappa_80-P1389 | 1763 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK | 1764 | QQLNSYPPYT |
| COV072_Plate2_Kappa_36-P1389 | 1767 | DIQLTQSPSFLSASVGDRVTITCRASQGISSYLAWYQQKPGKAPKLLIYAASTLQSGVPSRFSGSGSGTEFTLTISSLQPEDFATYYCQQLNSYSYTFGQGTKLEIK | 1768 | QQLNSYSYT |
| | | LAMBDA | | |
| COV072_Plate3_Lambda_49-P1409 | 1771 | SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPGVVFGGGTKLTVL | 1772 | QVWDSSSDHPGW |
| COV072_Plate2_Lambda_81-P1409 | 1775 | SYVLTQPPSVSVAPGKTARITCGGNNIGSKSVHWYQQKPGQAPVLVIYYDNDRPSGIPERFSGSNSGNTATLTISRVEAGDEADYYCQVWDGGSDHPGVVFGGGTKLTVL | 1776 | QVWDGGSDHPGW |
| COV072_Plate3_Lambda_51-P1409 | 1779 | SYVLTQPPSVSVAPGKTARITCGGNNIGSKSVHWYQQKPGQAPVLVIYYDSDRPSGIPERFSGSNSGNTATLTISRVEAGDEEYHCQVWDSSSDRPGVVFGGGTKLTVL | 1780 | QVWDSSSDRPGW |

TABLE 11-continued

Anti-SARS-CoV-2 IgG antibodies from COV72

| | | | | |
|---|---|---|---|---|
| COV072_Plate2_Lambda_93-P1409 | 1783 | SYVLTQPPSVSVAPGKTARITCGGNNIG SKSVHWYQQKPGQAPVLVIYYDSDRPS GIPERFSGSNSGNTATLTISRVEAGDEA EYHCQVWDSSSDRPGVVFGGGTKLTV L | 1784 | QV WDS SSD RPG W |
| COV072_Plate3_Lambda_12-P1409 | 1787 | NFMLNQPPCEXESPGKTVTISCTGSSG SIASNYDQWYQQRPGSAPTTVIYEDKQ RTSGVLDWFSGSXARSSNSPSLTIXGRK REDEADXYCQSYDSSKGVFGGGTKLTV L | 1788 | QSY DSS KGV |
| COV072_Plate2_Lambda_33-P1409 | 1791 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDSSNWVFGGGTKLTV L | 1792 | QSY DSS NW V |
| COV072_Plate3_Lambda_25-P1409 | 1795 | QSVLTQPASVSGSPGQSITISCTGTSSD VGGYNYVSWYQQH PGKAPKLMIYDVS NRPSGVSNRFSGSKSGNTASLTISGLQA EDEADYYCSSYTSSSTLLFGGGTKLTVL | 1796 | SSYT SSST LL |
| COV072_Plate2_Lambda_53-P1409 | 1799 | QSVLTQPASVSGSPGQSITISCTGTSSD VGGYNYVSWYQQH PGKAPKLMIYDVS NRPSGVSNRFSGSKSGNTASLTISGLQA EDEADYYCSSFTSSSTLLFGGGTRLTVL | 1800 | SSFT SSST LL |
| COV072_Plate3_Lambda_44-P1409 | 1803 | NFVLTQPHSVSESPGKTVTISCTGSSGSI ASNYVQWYQQRPGSAPTTVIYEDNQR PSGVPDRFSGSIDSSSNSASLTISGLKTE DEADYYCQSYDSSTWVFGGGTKLTVL | 1804 | QSY DSS TWV |
| COV072_Plate3_Lambda_40-P1409 | 1807 | QSVLTQPRSVSGSPGQSVTISCTGTSSD FGGYNYVSWYQQHPGKAPKLIVIIYDVS KRPSGVPDRFSGSKSGNTASLTISGLQA EDEADYYCCSYAGSYTRYVFGTGTKVT VL | 1808 | CSY AGS YTR YV |
| COV072_Plate3_Lambda_77-P1409 | 1811 | QSVLTQPPSVSGAPGQRVTISCTGSNS NIGAGYDVHWYQQLPGTAPKLLIYVNS NRPSGVPDRFSGSKSGTSASLAITGLQA EDEADYSCQSYDSSLSGSVFGTGTKVTV L | 1812 | QSY DSSL SGS V |
| KAPPA | | | | |
| COV072_Plate2_Kappa_9-P1389 | 1815 | EIVLTQSPATLSLSPGERATLSCRASQSV SSYLAWYQQKPGQAPRLLIYDASNRAT GIPARFSGSGSGTDFTLTISSLEPEDFAV YYCQQRSNWPPGVTFGQGTRLEIK | 1816 | QQR SNW PPG VT |
| COV072_Plate3_Kappa_34-P1389 | 1819 | DIVMTQSPLSLPVTPGEPASISCRSSQSL LYSNGYNYLDWYLQKPGQSPQLLIYLG SNRASGVPDRFSGSGSGTDFTLKISRVE AEDVGVYYCMQALQTPWTFGQGTKV EIK | 1820 | MQ ALQ TPW T |
| COV072_Plate3_Kappa_10-P1389 | 1823 | DIQMTQSPSSLSASVGDRVTITCRASQS SSRYLNWYQQKPGKAPKLLIYAASSLQS GVPSRFSGSGSGTDFTLTISSLQPEDFA TYYCQQSYRTRLTFGGGTKVEIK | 1824 | QQS YRT RLT |
| COV072_Plate3_Kappa_42-P1389 | 1827 | EIVLTQSPGTLSLSPGERATLSCRASQSF RSSYLAWYQQKPGQAPRLLIYGASSRA TGIPDRFSGSGSGSDFTLTISRLEPEDFA VYYCQQYDISPWTFGQGTKVEIK | 1828 | QQY DISP WT |
| COV072_Plate3_Kappa_31-P1389 | 1831 | EIVMTQSPATLSVSPGERATLSCRASQS VSSHLAWYQQKPGQAPRLLIYGASTRA TGIPARFSGSGSGTEFTLTISSLQSEDFA VYYCQQYHNWPPALTFGGGTKVEIK | 1832 | QQY HN WPP ALT |
| COV072_Plate3_Kappa_30-P1389 | 1835 | EIVMTQSPATLSVSPGERATLSCRASQS VSSNLAWYQQKPGQAPRLLIYGASTRA TGIPARFSGSGSGTEFTLTISSLQSEDFA VYYCQQYNNGLTFGGGTKVEIK | 1836 | QQY NNG LT |

TABLE 11-continued

Anti-SARS-CoV-2 IgG antibodies from COV72

| | | | | |
|---|---|---|---|---|
| COV072_Plate3_Kappa_48-P1389 | 1839 | EIVLTQSPGTLSLSPGERATLSCRASQSV SSTYLAWYQQKPGQAPRLLIYGASSRA TGIPDRFSGSGSGTDFTLTISRLEPEDFA VYYCQQYGSSPWTFGQGTKVEIK | 1840 | QQY GSS PWT |
| COV072_Plate2_Kappa_40-P1389 | 1843 | EIVLTQSPGTLSLPPGERATLSCRASQSV SSSYLAWYQQKPGQAPRLLIYGASSRA TGIPDRFSGSGSGTDFTLTISRLEPEDFA VYYCQQYANSRTFGQGTKVEIK | 1844 | QQY ANS RT |
| COV072_Plate3_Kappa_58-P1389 | 1847 | DIQMTQSPSSLSASVGDRVTITCQASQ DISNYLNWYQQKPGKAPKLLIYDASHL ETGVPSRFSGSGSGTDFTFTISSLQPEDI ATYYCQQYDNLPLTFGGGTKVEIK | 1848 | QQY DNL PLT |
| COV072_Plate3_Kappa_64-P1389 | 1851 | DIQMTQSPSSLSASVGDRVTITCRASQS ISSYLNWYQEKPGKAPKLLIYAASSLQS GVPSRFSGSGSGTDFTLTISSLQPEDFA TYYCQQSYSTRALTFGGGTKVEIK | 1852 | QQS YSTR ALT |
| COV072_Plate3_Kappa_5-P1389 | 1855 | DIQMTQSPSSLSASVGDRVTITCQASQ DISNYLNWYQQKPGKAPKLLIYDASNL ETGVPSRFSGSGSGTDFTFTISSLQPEDI ATYYCQQYDNLPPFTFGPGTKVHIK | 1856 | QQY DNL PPFT |
| COV072_Plate2_Kappa_92-P1389 | 1859 | DIQMTQSPSSLSASVGDRVTITCRASQ GISNYLAWYQQKPGKVPKLLIYAASTLQ SGVPSRFSGSGSGTDFTLTISSLQPEDVS TYYCQKYNSALGFTFGPGTKVDIK | 1860 | QKY NSA LGFT |
| COV072_Plate2_Kappa_15-P1389 | 1863 | DIQMTQSPSSLSASVGDRVTITCQASQ DISNYLNWYQQKPGKAPKLLIYDASNL ETGVPSRFSGSGSGTDFTFTISSLQPEDI ATYYCQQYDNLPITFGQGTRLEIK | 1864 | QQY DNL PIT |
| COV072_Plate3_Kappa_45-P1389 | 1867 | DIQMTQSPSTLSASVGDRVTITCRASQS ISNWLAWFQQKPGKAPKLLIYEAXSLES GVPSRFSGSGSGTEFTLTISSLQPDDFA TYYCQQYNSYPWTFGQGTKVEIK | 1868 | QQY NSY PWT |
| COV072_Plate2_Kappa_31-P1389 | 1871 | DIQMTQSPSSLSASVGDRVTITCQASQ DISNYLNWYQQKPGKAPKLLIYDASNL ETGVPSRFSGSESGTDFTFTISSLQPEDI ATYYCQQYDNLPITFGQGTRLEIK | 1872 | QQY DNL PIT |
| COV072_Plate3_Kappa_3-P1389 | 1875 | DIQMTQSPSSLSASVGDRVTITCQASQ DISNYLNWYQQKPGKAPKLLIYDASNL ETGVPSRFSGSGSGTDFTFTISSLQPEDI ATYYCQQYDNLPFTFGPGTKVDIK | 1876 | QQY DNL PFT |
| COV072_Plate3_Kappa_37-P1389 | 1879 | DIQMTQSPSSLSASVGDRVTITCQASQ DISNYLNWFQQKPGKAPKLLIYAASDLE TGVPSRFSGSGSGTDFTFTISSLQPEDIA SYYCLQYDNLPLTFGGGTKVEIK | 1880 | LQY DNL PLT |
| COV072_Plate2_Kappa_63-P1389 | 1883 | DIQMTQSPSSLSASVGDRVTITCQASQ DISNYLNWYQQKPGKAPKLLIYDASNL ETGVPSRFSGSGSGTDFTFTISSLQPEDI ATYYCQQYDNLPLTFGGGTKVEIK | 1884 | QQY DNL PLT |
| COV072_Plate3_Kappa_69-P1389 | 1887 | DIQMTQSPSSLSASVGDRVTITCRASQS ISSYLNWYQQKAGKAPKLLIYAASSLQS GVPSRFSGSGSGTDFTLTISSLQPEDFA TYYCQQSYSTFMYTFGQGTKLEIK | 1888 | QQS YSTF MYT |
| COV072_Plate3_Kappa_74-P1389 | 1891 | DIQMTQSPSSLSASVGDRVTITCRASQS ISSYLNWYQQKPGKAPKLLIYAASSLQS GVPSRFSGSGSGTDFTLTISSLQPEDFA TYYCQQTYITPPSFGPGTKVDIK | 1892 | QQT YITP PS |
| COV072_Plate2_Kappa_12-P1389 | 1895 | DIQMTQSPSTLSASVGDRVTITCRASQS ISSWLAWYQQKPGKAPKLLIYKASSLES GVPSRFSGSGSGTEFTLTISSLQPDDFA TYYCQQYNSYPWTFGQGTKVEIK | 1896 | QQY NSY PWT |
| COV072_Plate2_Kappa_23-P1389 | 1899 | DIVMTQSPLSLPVTPGEPASISCRSSQSL LHSNGYNYLDWYLQKPGQSPQLLIYLG SNRASGVPDRFSGSGSGTDFTLKISRVE AEDVGVYYCMQALQTFTFGPGTKVDIK | 1900 | MQ ALQ TFT |

TABLE 11-continued

Anti-SARS-CoV-2 IgG antibodies from COV72

| | | | | |
|---|---|---|---|---|
| COV072_Plate3_Kappa_68-P1389 | 1903 | DIQMTQSPSSLSASLGDRVTITCQASQDISNYLNWYQQKPGKAPKLLIYDASNLETGVPSRFSGSGSGTDFTFTISSLQPEDIATYYCQQYDNLPPITFGQGTRLEIK | 1904 | QQYDNLPPIT |
| COV072_Plate2_Kappa_72-P1389 | 1907 | DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK | 1908 | QQYDNLPYT |
| COV072_Plate2_Kappa_25-P1389 | 1911 | AIQMTQSPSSLSASVGDRVTITCRAGQGIRNDLGWYQQKPGKAPKLLIYAASSLQSGVPSRFSGSGSGTDFTLTISSLQPEDFATYYCLQDYNYPYTFGQGTKLEIK | 1912 | LQDYNYPYT |
| COV072_Plate2_Kappa_54-P1389 | 1915 | DVVMTQSPLSLPVTLGQPASISCRSSQSLVYNDGNTYLNWFQQRPGQSPRRLIYKVSNRDSGVPDRFSGSGSGTDFTLKISRVEAEDVGVYYCMQGTHCPFTFGPGTKVDIK | 1916 | MQGTHCPFT |
| COV072_Plate2_Kappa_78-P1389 | 1919 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK | 1920 | MQALQTPWT |
| COV072_Plate3_Kappa_26-P1389 | 1923 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPLLTFGGGTKVEIK | 1924 | QQLNSYPLLT |
| COV072_Plate3_Kappa_67-P1389 | 1927 | DIQMTQSPSSLSASVGDRVTITCQASQDISNYLNWYQQKPGKAPKLLIYDASNLETGVPSRFSGSGSGTDFTFTISTLQPEDIATYYCQQYDNLPITFGGGTKVEIK | 1928 | QQYDNLPIT |
| COV072_Plate2_Kappa_89-P1389 | 1931 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPTFGQGTKLEIK | 1932 | QQLNSYPT |
| COV072_Plate3_Kappa_22-P1389 | 1935 | DIQMTQSPSSLSASVGDRVTITCRASQSISNYLNWYQQKPGKAPKLLIYAASSLQSAVPSRFSGSGSGTDFTLTISSLQPEDFATYFCQQSYTTPYTFGQGTKLEIK | 1936 | QQSYTTPYT |
| COV072_Plate3_Kappa_47-P1389 | 1939 | DIQMTQSPSSLSASVGDRVTITCQASQDISKYLNWYQQKPGKAPKLLIYDASNLETGVPSRFSGSGSGTDFTFTISSLQPEDFATYYCQHYDSLSRLTFGGGTKVEIK | 1940 | QHYDSLSRLT |
| COV072_Plate3_Kappa_59-P1389 | 1943 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGGGTKVEIK | 1944 | QQLNSYPPP |
| COV072_Plate2_Kappa_16-P1389 | 1947 | DIQLTQSPSFLSASVGDRVTITCRASQGISSYLAWYQQKPGKAPKLLIYAASTLQSGVPSRFSGSGSGTEFTLTISSLQPEDFATYYCQQPDSFTFGPGTKVDIK | 1948 | QQPDSFT |
| COV072_Plate2_Kappa_37-P1389 | 1951 | DVVMTQSPLSLPVTLGQPASISCRSSQSLVYSDGDTYLNWFQQRPGQSPRRLIYKVSNRDSGVPDRFSGSGSGTDFTLKISRVEAEDVGVYYCMQGTHWPKTFGQGTKLEIK | 1952 | MQGTHWPKT |
| COV072_Plate2_Kappa_86-P1389 | 1955 | DIQMTQSPSSLSASVGDRVTITCQASQDISSYLNWYQQKPGKAPKLLIYDASNLETGVPSRFSGSGSGTDFTFTISSLQPEDIATYYCQQYDILPPMYTFGQGTKLEIK | 1956 | QQYDILPPMYT |
| COV072_Plate2_Kappa_32-P1389 | 1959 | EIVLTQSPGTLSLSPGERATLSCRASLSVSSSYLAWYQQKPGQAPRLLIYGASSRATGIPDRFSGSGSGTDFTLTISRLEPEDFAVYYCQQYGSSPLTFGGGTKVEIK | 1960 | QQYGSSPLT |

TABLE 11-continued

Anti-SARS-CoV-2 IgG antibodies from COV72

| | | | | |
|---|---|---|---|---|
| COV072_Plate2_Kappa_67-P1389 | 1963 | EIVLTQSPATLSLSPGERATLSCRASQSV SSYLAWYQQKPGQAPRLLIYDASNRAT GIPARFSGSGSGTDFTLTISSLEPEDFAV YYCQQRSNWPPLTFGGGTKVEIK | 1964 | QQR SNW PPLT |
| COV072_Plate2_Kappa_88-P1389 | 1967 | DIQMTQSPSSLSASVGDRVTITCQASQ DISNSLNWYQQKPGKAPKVLIYDASNL ETGVPSRFSGSGSGTDFTFTISSLQPEDF ATYYCQQYDNLPFTFGPGTKVDIK | 1968 | QQY DNL PFT |
| COV072_Plate2_Kappa_74-P1389 | 1971 | DIQMTQSPSSLSASVGDRVTITCRASQS ISSYLNWYQQKPGKAPKLLIYAASSLQS GVPSRFSGSGSGTDFTLTISSLQPEDFA TYYCQQSYSIPQITFGQGTRLEIK | 1972 | QQS YSIP QIT |
| COV072_Plate3_Kappa_4-P1389 | 1975 | EIVMTQSPATLSVSPGERATLSCRASQS VSSNLAWYQQRPGQAPRLLIYGASTRA TGIPARFSGSGSGTEFTLTISSLQSEDFA VYYCQQYNNWPPWTFGQGTKVEIK | 1976 | QQY NN WPP WT |
| LAMBDA | | | | |
| COV072_Plate3_Lambda_54-P1409 | 1979 | QSVLTQPPSVSGAPGQRVTISCTGSSS NIGAGYDVKWYQQLPGTAPKLLIYGNS NRPSGVPDRFSGSKSGTSASLAITGLQA EDEADYYCQSYDSSLSGLWVFGGGTKL TVL | 1980 | QSY DSSL SGL WV |
| COV072_Plate3_Lambda_94-P1409 | 1983 | NFMLTQPHSVSESPGKTVTISCTGSSGS IASNYVQWYQQRPGSAPTIVIYEDNQR PSGVPDRFSGSIDSSSNSASLTISGLKTE DEADYYCQSYDSTTHVVFGGGTKLIVL | 1984 | QSY DST THV V |
| COV072_Plate3_Lambda_91-P1409 | 1987 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDSSNWVFGGGTKLTV L | 1988 | QSY DSS NW V |
| COV072_Plate2_Lambda_14-P1409 | 1991 | QSVLTQPASVSGSPGQSITISCTGTSSD VGSYNLVSWYQQHPGKAPKLMIYEVS KRPSGVSNRFSGSKSGNTASLTISGLQA EDEADYYCCSYGGSSTSFYVFGTGTKVT VL | 1992 | CSY GGS STSF YV |
| COV072_Plate3_Lambda_1-P1409 | 1995 | QSALTQPASVSGSPGQSITISCTGTSSD VGSYNLVSWYQQHPGKAPKLMIYEVS KRPSGVSNRFSGSKSGNTASLTISGLQA EDEADYYCCSYAGSSTWVFGGGTKLTV L | 1996 | CSY AGS STW V |
| COV072_Plate3_Lambda_71-P1409 | 1999 | QSVLTQEPSFSVSPGGTVTLTCGLSSGS VSTSYYPSWYQQTPGQPPRTLIYITNTR SSGVPDRFSGSILGNKAALTITGAQADD ESDYYCVLYMGSSNWVFGGGTKLTVL | 2000 | VLY MGS SNW V |
| COV072_Plate2_Lambda_5-P1409 | 2003 | SYVLTQPPSVSVAPGKTARITCGGNNIG SKSVHWYQQKPGQAPVLVIYYDSDRPS GIPERFSGSKSGNTATLTISRVEAGDEA DYYCQVWDSSSDHRVFGGGTKLTVL | 2004 | QV WDS SSD HRV |
| COV072_Plate2_Lambda_71-P1409 | 2007 | SYVLTQPPSVSVSPGQTARITCSGDTLP KQYVYWYQQKPGQAPALVIYKDSERPS GIPERLSGSSSGTTATLTISGVQAEDEA DYYCQSADSSGTRFGGGTKLTVL | 2008 | QSA DSS GTR |
| COV072_Plate3_Lambda_73-P1409 | 2011 | SYVLTQPPSVSVAPGKTARITCGGNNIG SKSVHWYQQKPGQAPVLVIYYDSDRPS GIPERFSGSNSGNTATLTISRVEAGDEA DYYCQVWDGTSDHPGWVFGGGTKLT VL | 2012 | QV WD GTS DHP GW V |
| COV072_Plate2_Lambda_76-P1409 | 2015 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDSSNVVFGGGTKLTVL | 2016 | QSY DSS NVV |

TABLE 11-continued

Anti-SARS-CoV-2 IgG antibodies from COV72

| | | | | |
|---|---|---|---|---|
| COV072_Plate3_Lambda_18-P1409 | 2019 | SYVLTQPPSVSVAPGKTARITCGGNNIG SKNVHWYQQKPGQAPVLVVYYDSDR PSGIPERFSGSNSGNTATLTISRVEAGD EADYYCQVWDSSSGHFHVVFGGGTKL TVL | 2020 | QV WDS SSG HFH W |
| COV072_Plate3_Lambda_84-P1409 | 2023 | SYVLTQPPSVSVSPGQTASITCFGDKLG DKYACWYQQKPGQSPVLVIYQDSKRP SGIPERFSGSNSGNTATLTISGTQAMDE ADYYCQAWDSSTPHVVFGGGTKLTVL | 2024 | QA WDS STP HVV |
| COV072_Plate3_Lambda_55-P1409 | 2027 | SYVLTQPPSVAVSPGQTARITCSGDALP KQYAYWYQQKPGQAPVLVIYKDSERPS GIPERFSGSSSGTTVTLTISGVQAEDEA DYYCQSADSSGTYEVFGGGTKVTVL | 2028 | QSA DSS GTY EV |
| COV072_Plate3_Lambda_38-P1409 | 2031 | SYELTQPPSVSVSPGQTASITCSGDKLG DKYTCWYQQKPGQSPVLVIYQDTQRP SGIPERFSGSNSGNTATLTISGTQAMDE ADYYCQAWDSSTGVVFGGGTKVTVL | 2032 | QA WDS STG W |
| COV072_Plate3_Lambda_36-P1409 | 2035 | QSVLTQPPSVSEAPRQRVTISCSGSSSN IGNNAVNWYQQLPGKAPKLLIYYDDLL PSGVSDRFSGSKSGTSASLAISGLQSED EADYYCAAWDDSFNGPVFGGGTKLTV L | 2036 | AA WD DSF NGP V |
| COV072_Plate2_Lambda_94-P1409 | 2039 | QSVLTQPASVSGSPGQSITISCTGTSSD VGSYNLVSWYQQHPDKAPKLMIYEVS KRPSGVSNRFSGSKSGNTASLTISGLQA EDEADYYCCSYAGTSTYVFGTGTKLTVL | 2040 | CSY AGT STYV |
| COV072_Plate3_Lambda_56-P1409 | 2043 | QSVLTQPPSVSGAPGQRVTISCTGSSS NIGAGYDVHWYQQLPGTAPKLLIYGNS NRPSGVPDRFSGSKSGTSASLAITGLQA EDEADYYCQSYDSSLSGFYVFGTGTKVT VL | 2044 | QSY DSSL SGF YV |

TABLE 12

Anti-SARS-CoV-2 IgG antibodies from COV96

| SEQUENCE_ID | SEQ ID NO | aa | SEQ ID NO | cdr3_aa |
|---|---|---|---|---|
| HEAVY | | | | |
| COV096_HC_100-pl369 | 2045 | EVQLLESGGGLEQPGGSLRLSCAASGFTFSTYAM SWVRQAPGKGLEWVSAISGSGAGTFYADSVKGR FTISRDNSKNTLYLQMNSLRAEDTAVYYCARESD CGSTSCYQVGWFDPWGQGTLVTVSS | 2046 | ARESDCG STSCYQV GWFDP |
| COV096_HC_164-pl369 | 2049 | EVQLLESGGGLVQPGTSLRLSCAASGFTFSSYAMS WVRQAPGKGLEWVSAISSSGGSTYYADSVKGRF TISRDNSKNTLYLHMNSLRAEDTAVYYCATERIAV AGTRMYNWFDPWGQGTLVTVSS | 2050 | ATERIAVA GTRMYN WFDP |
| COV096_HC_25-pl369 | 2053 | EVQLLESGGGLVQPGGSLRLSCAASGFTFSSYAM SWVRQAPGKGLEWVSAITDSGDGTFYADSVKGR FTISRDNSKNTLYLQMNSLRAEDTAVYYCASEEDY SNYVGWFDPWGQGTLVTVSS | 2054 | ASEEDYS NYVGWF DP |
| COV096_HC_91-pl369 | 2057 | EVQLLESGGGLEQPGGSLRLSCAASGFTFSTYAM SWVRQAPGKGLEWVSAISGSGAGTFYADSVKGR FTISRDNSKNTLYLQMNSLRAEDTAVYYCARESD CGSTSCYQVGWFDPWGQGTLVTVSS | 2058 | ARESDCG STSCYQV GWFDP |
| COV096_HC_91-pl369 | 2061 | EVQLLESGGGLEQPGGSLRLSCAASGFTFSTYAM SWVRQAPGKGLEWVSAISGSGAGTFYADSVKGR FTISRDNSKNTLYLQMNSLRAEDTAVYYCARESD CGSTSCYQVGWFDPWGQGTLVTVSS | 2062 | ARESDCG STSCYQV GWFDP |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_115-pl369 | 2065 | EVQLVESGGGLVQPGGSLRLSCAASGFTVSSNYM SWVRQAPGKGLEWVSLIYSGGSTYYADSVKGRFT ISRDNSKNTLYLQMNSLRAEDTAVYYCARDTLGR GGDYWGQGTLVTVSS | 2066 | ARDTLGR GGDY |
| COV096_HC_133-pl369 | 2069 | EVQLVESGGGLVQPGGSLRLSCAASGFTVSSNYM SWVRQAPGKGLEWVSLIYSGGSTYYADSVKGRFT ISRDNSKNTLYLQMNSLRAEDTAVYYCARDTFGR GGDYWGQGTLVTVSS | 2070 | ARDTFGR GGDY |
| COV096_HC_34-pl369 | 2073 | EVQLVESGGGLVQPGGSLRLSCAASGFTVSSNYM SWVRQAPGKGLEWVSLIYSGGSTYYADSVKGRFT ISRDNSKNTLYLQMNTLRAEDTAVYYCARDTLGR GGDYWGQGTLVTVSS | 2074 | ARDTLGR GGDY |
| COV096_HC_34-pl369 | 2077 | EVQLVESGGGLVQPGGSLRLSCAASGFTVSSNYM SWVRQAPGKGLEWVSLIYSGGSTYYADSVKGRFT ISRDNSKNTLYLQMNTLRAEDTAVYYCARDTLGR GGDYWGQGTLVTVSS | 2078 | ARDTLGR GGDY |
| COV096_HC_106-pl369 | 2081 | EVQLVESGGGLVQPGRSLRLSCAASGFTFDDYA MHWVRQAPGKGLEWVSGISWNSDSIGYADSVK GRFTISRDNAKNSLYLQMNSLTAEDTALYYCAKG VEYSSSSNFDYWGQGTLVTVSS | 2082 | AKGVEYS SSSNFDY |
| COV096_HC_132-pl369 | 2085 | EVQLVESGGGLVQPGRSLRLSCAASGFTFDDYA MHWVRQAPGKGLEWVSGISWNSGSIGYADSVK GRFTISRDNAKNSLYLQMNSLRAEDTALYYCVKG VEYSSSSNFDYWGQGTLVTVSS | 2086 | VKGVEYS SSSNFDY |
| COV096_HC_6-pl369 | 2089 | EVQLVESGGGLVQPGRSLRLSCAASGFTFDDYA MHWVRQAPGKGLEWVSGISWNSGSIGYADSVK GRFTISRDNAKNSLYLQMNSLRAEDTALYYCVKG VEYSSSSNFDYWGQGTLVTVSS | 2090 | VKGVEYS SSSNFDY |
| HEAVY | | | | |
| COV096_HC_116-pl369 | 2093 | QVQLVQSGAEVKKPGASVKVSCKASGYTVTGYYI HWVRQAPGQGLEWMGWISPNSGGTNYAQKF QGWVTMTRDMSITTAYMELSRLRSDDTAVYYCA RERYFDLGGMDVWGQGTTVTVSS | 2094 | ARERYFDL GGMDV |
| COV096_HC_77-pl369 | 2097 | QVQLVQSGAEVKKPGASVKVSCKASGYTVTGYYI HWVRQAPGQGLEWMGWISPNSGGTNYAQKF QGWVTMTRDMSITTAYMELSRLRSDDTAVYYCA REPYFDLGGMDVWGQGTTVTVSS | 2098 | AREPYFDL GGMDV |
| COV096_HC_138-pl369 | 2101 | QVQLVQSGAEVKKSGASVKVSCKASGYTFTSYDI NWVRQATGQGLEWMGWMNPNSGNTGYAQK FQGRVTMTRNTSISTAYMDLSSLRSEDTAVYYCA RGFSLTWYFDLWGRGTLVTVSS | 2102 | ARGFSLT WYFDL |
| COV096_HC_176-pl369 | 2105 | QVQLVQSGAEVKKPGASVKVSCKASGYTFTSYDV NWVRQATGQGLEWMGWMNPNSGSAGYAQK FQGRVTMTRNTSISTAYMELSSLRSEDTAVYYCA RGFSLTWYFDLWGRGTLVTVSS | 2106 | ARGFSLT WYFDL |
| COV096_HC_104-pl369 | 2109 | EVQLVESGGGLVKPGGSLRLSCAASGFTFSSYSM NWVRQAPGKGLEWVSFISSRSSYIYYADSVKGRF TISRDNAKNSLYLQMNSLRAEDTAVYYCARVQVG ARGWVDYWGQGTLVTVSS | 2110 | ARVQVGA RGWVDY |
| COV096_HC_111-pl369 | 2113 | EVQLVESGGGLVKPGGSLRLSCAASGFTFSSYSM NWVRQAPGKGLEWVSSISSSSSYIYYADSVKGRF TISRDNAKNSLYLQMNSLRAEDTAVYYCARVQVG ARGWVDYWGQGTLVTVSS | 2114 | ARVQVGA RGWVDY |
| HEAVY | | | | |
| COV096_HC_158-pl369 | 2117 | EVQLLESGGGLVQPGGSLRLSCAASGFTFSSYAM SWVRQAPGKGLEWVSAISGSGGSTYYADSVKGR FTISRDNSKNTLYLQMNSLRAEDTAVYYCAKEPIG QPLLWWDYWGQGTLVTVSS | 2118 | AKEPIGQ PLLWWD Y |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_78-pl369 | 2121 | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS | 2122 | AKEPIGQPLLWWDY |
| COV096_HC_130-pl369 | 2125 | EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS | 2126 | AKGSSSGWTRPLDY |
| COV096_HC_44-pl369 | 2129 | EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS | 2130 | AKGSSSGWTRPLDY |

| HEAVY |||||
|---|---|---|---|---|
| COV096_HC72-pl369 | 2133 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRPRDYYDRSGYYYVPGYFDYWGQGTLVTVSS | 2134 | ARRPRDYYDRSGYYYVPGYFDY |
| COV096_HC_4-pl369 | 2137 | QVQLVQSGAEVKKPGASVKVSCKASGSTFTGYYMHWVRQAPGQGLEWMGWINPNSGGTNYAQKFQGWVTMTRDTSISTAYMELSRLRSDDTAVYYCAREKVATMFALPPYGMDVWGQGTTVTVSS | 2138 | AREKVATMFALPPYGMDV |
| COV096_HC_127-pl369 | 2141 | QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS | 2142 | ARPLLPGETGSLNRLDY |
| COV096_HC_113-pl369 | 2145 | QVQLVQSGAEVKKPGASVKVSCKASGHTFTSYYMHWVRQAPGQGLEWMGIINPSGGSTSYAQKFQGRVTMTRDTSTSTVYMELSSLRSEDTAVYYCARGPERGIVGATDYFDYWGQGTLVTVSS | 2146 | ARGPERGIVGATDYFDY |
| COV096_HC_153-pl369 | 2149 | QVQLVQSGAEVKKPGSSVKVSCKASGGTFSSNAISWVRQAPGQGLEWMGGITPIFGTVNYAQKFQGRVTITADESTSTAYMELSSLRSEDTAVYYCASEWEIFGFDYWGQGTLVTVSS | 2150 | ASEWEIFGFDY |
| COV096_HC_55-pl369 | 2153 | QVQLVQSGAEVKKPGSSVKVSCKASGGTFSSYAISWVRQAPGQGLEWMGGIIPIFGTTNHAQKFQGRVTITADESTSTAYMELSSLRSEDTAVYYCTSGQGAGVNRGVVITTLGYWGQGTLVTVSS | 2154 | TSGQGAGVNRGVVITTLGY |
| COV096_HC_42-pl369 | 2157 | QVQLVQSGAEVKKPGSSVKVSCKASGGTISSYAISWVRQAPGQGLEWMGGIIPIFGTTNYAQKFQGRVTITADESTSTAYMELSSLRSEDTALYYCARDDGQQLWSYFDYWGQGTLVTVSS | 2158 | ARDDGQQLWSYFDY |
| COV096_HC_156-pl369 | 2161 | QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLPPRRFDIWGQGTMVTVSS | 2162 | ARDLPPRRFDI |
| COV096_HC_137-pl369 | 2165 | EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGDSGSYLGVWYFDLWGRGTLVTVSS | 2166 | ARGDSGSYLGVWYFDL |
| COV096_HC_75-pl369 | 2169 | EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARDRGSSGWYGWYFDLWGRGTLVTVSS | 2170 | ARDRGSSGWYGWYFDL |
| COV096_HC_123-pl369 | 2173 | EVQLVESGGGLVQPGGSLRLSCAASGFIFSSYDMHWVRQATGKGLEWVSTIGTAGDTYYPDSVKGRFTISRENAKNSLYLQMNSLRAGDTAVYYCARGDYNILTGYYFDYWGQGTLVTVSS | 2174 | ARGDYNILTGYYFDY |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_65-pl369 | 2177 | EVQLVESGGGLVQPGGSLRLSCAASGFTFSSYDMHWVRQATGKGLQWVSAIGTAGDTYYPDSVKGRFTISRENAKNSLYLQMNSLRAGDTAVYYCARDRDSSWSFDYWGQGTLVTVSS | 2178 | ARDRDSSWSFDY |
| COV096_HC_81-pl369 | 2181 | EVQLVESGGGLVQPGGSLRLSCAASGFTFSSYDMHWVRQASGKGLEWVSAIGTSGDTYYPGSVKGRFTISRENAKNSLYLQMNSLRAGDTAVYYCARGTFFYGSGSYNWFDPWGQGTLVTVSS | 2182 | ARGTFFYGSGSYNWFDP |
| COV096_HC_166-pl369 | 2185 | EVQLVESGGGLVKPGGSLRVSCAASGFSFYAWMSWVRQAPGKGLEWVGRIKSKTDGGTTDCAAPVKGRFTISRDDSKNTLYLQMNSLKTEDTAVYYCTTLSDYGDLSSVYWGQGTLVTVSS | 2186 | TTLSDYGDLSSVY |
| COV096_HC_140-pl369 | 2189 | EVQLVESGGGLVKPGGSLRLSCAASGFTVRSYSMNWVRQAPGKGLEWVSCMTSSGSYLYYADSVKGRFTISRDNAKNSLYLQMNSLRDEDTAVYYCAKEEYYGMDVWGQGATVTVSS | 2190 | AKEEYYGMDV |
| COV096_HC_43-pl369 | 2193 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCAKQLYYYGSGSYVFDYWGQGTLVTVSS | 2194 | AKQLYYYGSGSYVFDY |
| COV096_HC_21-pl369 | 2197 | QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS | 2198 | AKDTPGGDDILTGWGLYGMDV |
| COV096_HC_122-pl369 | 2201 | QVQLVESGGGVVQPGRSLRLSCAASGFTFSNYGMHWVRQAPGKGLEWVAVIWYDGSNKHYADSVKGRFTISRDNSKNTLYLQMNSLRAEDTAEYYCARDMGTLVTHFDYWGQGTLVTVSS | 2202 | ARDMGTLVTHFDY |
| COV096_HC_98-pl369 | 2205 | QVQLVESGGGVVQPGRSLRLSCAASGFTFSSYGMHWVRQAPGKGLEWVAAIWYDGSNKHYADSVKGRFTISRDNSKNTLYLQMNSLRAEDTAVYYCARDVGRVTTWFDPWGQGTLVTVSS | 2206 | ARDVGRVTTWFDP |
| COV096_HC_48-pl369 | 2209 | EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARASGLRSYYYYGMDVWGQGTTVTVSS | 2210 | ARASGLRSYYYYGMDV |
| COV096_HC_79-pl369 | 2213 | EVQLVESGGGLVQPGGSLRLSCAASGFTFTNYNMNWVRQAPGKGLEWVSYISSSSSTIYYADSVKGRFTISRDNAKNSLYLQMNSLRDEDTAVYYCARVVGSGSYYYYGMDVWGQGTTVTVSS | 2214 | ARVVGSGSYYYYGMDV |
| COV096_HC_3-pl369 | 2217 | EVQLVESGGGLVQPGRSLRLSCTASGFTFGDYAMNWFRQAPGKGLEWVGFIRSKAYGGTTEYAASVRGRFTISRDDSESIAYLQMNSLKTEDTAVYYCTRDLSYYYDSSGRGSHLFDYWGQGTLVTVSS | 2218 | TRDLSYYYDSSGRGSHLFDY |
| COV096_HC_3-pl369 | 2221 | EVQLVESGGGLVQPGRSLRLSCTASGFTFGDYAMNWFRQAPGKGLEWVGFIRSKAYGGTTEYAASVRGRFTISRDDSESIAYLQMNSLKTEDTAVYYCTRDLSYYYDSSGRGSHLFDYWGQGTLVTVSS | 2222 | TRDLSYYYDSSGRGSHLFDY |
| COV096_HC_134-pl369 | 2225 | EVQLVESGGGLIQPGGSLRLSCAASGFTVSSNYMSWVRQAPGKGLEWVSVIYSGGSTFYADSVKGRFTFSRDNSKNTLYLQMNSLRAEDTAVYYCARDLMAYGMDVWGQGTTVTVSS | 2226 | ARDLMAYGMDV |
| COV096_HC_68-pl369 | 2229 | EVQLVESGGGLIQPGGSLRLSCAASGVIVSSNYMSWVRQAPGKGLEWVSVIYSGGSTYYADSVKGRFTISRDNSKNTLYLQMNSLRAEDTAVYYCARDGGHYGMDVWGQGTTVTVSS | 2230 | ARDGGHYGMDV |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_183-p1369 | 2233 | EVQLVESGGGLIQPGGSLRLSCAASGLTVSRNYMNWVRQAPGKGLEWVSVMYSGGSTFYADSVKGRFTISRDNSKNTLYLQMNSLRAEDTAVYYCARESYGMDVWGQGTTVTVSS | 2234 | ARESYGMDV |
| COV096_HC_74-p1369 | 2237 | EVQLVESGGGLVQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS | 2238 | ARDYGDFYFDY |
| COV096_HC_45-p1369 | 2241 | EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVAVSS | 2242 | TRDDSSWPHFFDN |
| COV096_HC_126-p1369 | 2245 | EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVTVSS | 2246 | TRDDSSWPHFFDN |
| COV096_HC_8-p1369 | 2249 | EVQLVQSGAEVKKPGESLKISCKGSGYTFTSYWIGWVRQMPGKGLEWMGFIYPGDSDTRYSPSFQGQVTISADKSISTAYLQWSSLKASDTAMYYCARPVTYDWYFDLWGRGTLVTVSS | 2250 | ARPVTYDWYFDL |
| COV096_HC_124-p1369 | 2253 | EVQLVQSGAEVKKPGESLKISCKVSGYTFTNYWIGWVRQMPGKGLEWMGIIYPGDSDTRYSPSFQGQVTISADKSIITAYLQWSSLKASDTAMYYCARVPSSSDYGDYGGFEYWGQGTLVTVSS | 2254 | ARVPSSSDYGDYGGFEY |
| COV096_HC_28-p1369 | 2257 | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARMVTSGTYYYDNSGYSSSGPFDYWGQGTLVTVSS | 2258 | ARMVTSGTYYYDNSGYSSSGPFDY |
| COV096_HC_12-p1369 | 2261 | EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS | 2262 | ARLSDRWYSPFDP |
| HEAVY | | | | |
| COV096_HC_90-p1369 | 2265 | QVQLVQSGAELKKPGASVKVSCKASGYTFNSYGISWVRQAPGQGLEWMGGISAYNGNTNYAQKLQGRVTMTTDTSTSTAYMELRSLRSDDTAVYYCARRVEDNGDDGGDYYYYYGMDVWGQGTTVTVSS | 2266 | ARRVEDNGDDGGDYYYYYGMDV |
| COV096_HC_71-p1369 | 2269 | QVQLVQSGAEVKKPGASVKVSCKASGYTFTGYSMHWVRQAPGQGLEWMGWINPNSGGTNYAQKFQGRVTMTRDTSISTAYMELSRLGSDDTAVYYCARDLEYCSSTSCYTSTTFDYWGQGTLVTVSS | 2270 | ARDLEYCSSTSCYTSTTFDY |
| COV096_HC52-p1369 | 2273 | QVQLVQSGAEVKKPGASVKVSCKASGYTFTDYYMHWVRQAPGQGLEWMGWINPNSGGTNYAQKFQGRVTMTRDTSISTAYMELSRLRSDDTAVYYCASGIGHNWNYVSTPNGMDVWGQGTTVTVSS | 2274 | ASGIGHNWNYVSTPNGMDV |
| COV096_HC_10-p1369 | 2277 | QVQLVQSGAEVKKPGASVRVSCKASGYTFTGYYIHWVRQAPGQGLEWMGWINPMSGGTNYTQKFQGWVTMTRDTSINTAYMELSRLRSDDTAVYYCARDFAMGTVTGTFVYWGQGTLVTVSS | 2278 | ARDFAMGTVTGTFVY |
| COV096_HC_2-p1369 | 2281 | QVQLVQSGAEVKKPGASVKVSCKASGYTFTSYYMHWVRQAPGQGLEWMGIINPSGGSTRYAQKFQGRVTMTRDTSTSVYMELSSLRSEDTAVYYCAREGVGGTSYFDYWGQGTLVTVSS | 2282 | AREGVGGTSYFDY |
| COV096_HC_30-p1369 | 2285 | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGLSGHFPHNWFDPWGQGTLVTVSS | 2286 | ARDGLSGHFPHNWFDP |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_136-p1369 | 2289 | QVQLVQSGAEVKKPGSSVKVSCKASGGTFSSYAIS WVRQAPGQGLEWMGGIIPIFGTANYAQKFQGR VTITADESTSTAYMELSSLRSEDTAVYYCARREAY GPRDYYYYGMDVWGQGTTVTVSS | 2290 | ARREAYG PRDYYYYY GMDV |
| COV096_HC_99-p1369 | 2293 | QVQLVQSGAEVKKPGSSVKVSCKASGGTFSSYAIS WGRQAPGQGLEWMGGIIPILGTVNYAQKFQGR VTITADKSTSTAYMELSSLRSEDTAVYYCARVLGY YDSSGSNDAFDIWGQGTMVTVSS | 2294 | ARVLGYY DSSGSND AFDI |
| COV096_HC_152-p1369 | 2297 | QVQLVQSGAEVKKPGASVKVSCKASGYTFTSYDI NWVRQATGQGLEWMGWMNPNSGNTGYAQK FQGRVTITRDTSISTAYMELSSLRXEDTAVYYCAR GGRYCSDVSCYSGTGFDYWGQGTLVTVSS | 2298 | ARGGRYC SDVSCYS GTGFDY |
| COV096_HC_50-p1369 | 2301 | EVQLVESGGGLVKPGGSLRLSCAASGFTFSNAW MSWVRQAPGKGLEWVGRIKSKTDGGTTDYAAP VKGRFTISRDDSKNTLYLQMNSLKTEDTAVYYCTT DLGYCSSTNCYYYWGQGTLVTVSS | 2302 | TTDLGYCS STNCYYYY |
| COV096_HC_92-p1369 | 2305 | EVQLVESGGGLVKPGGSLRLSCAASGFTFSNAW MSWVRQAPGKGLEWVGRIKSKTDGGTTDYAAP VKGRFTISRDDSKNTLYLQMNSLKTEDTAVYYCTT DDPGSYYYGMDVWGQGTTVTVSS | 2306 | TTDDPGS YYYGMDV |
| COV096_HC_40-p1369 | 2309 | QVQLVESGGGVVQPGRSLRLSCAASGFTFSSYA MHWVRQAPGKGLEWVALISYDGSNKHYADSVK GRFTISRDNSKNTLYLQMNSLRAEDTAVYYCARA GTTNSDYFDYWGQGTLVTVSS | 2310 | ARAGTTN SDYFDY |
| COV096_HC_149-p1369 | 2313 | QVQLVESGGGVVQPGRSLRLSCAASGFTFSSYG MHWVRQAPGKGLEWVAVISYDGSNKYYADSVK GRFTISRDNSKNTLYLQMNSLRAEDTAVYYCAKG GYSYGYSLYYFDYWGQGTLVTVSS | 2314 | AKGGYSY GYSLYYFD Y |
| COV096_HC_157-p1369 | 2317 | QVQLVESGGGVVQPGRSLRLSCAASGFTFSSYG MHWVRQAPGKGLEWVAVISYDGSNKYYADSVK GRFTISRDNSKNTLYLQMNSLRAEDTAVYYCAKA QYSYGYWYYFDYWGQGALVTVSS | 2318 | AKAQYSY GYVVYYF DY |
| COV096_HC_121-p1369 | 2321 | EVQLVESGGGLIQPGGSLRLSCAASGFTVSSNYM SWVRQAPGKGLEWVSVISSGGGTFYADSVKGRF TISRDNSKNTLYLQMNSLRAEDTAVYYCARSLWL RGSFQHWGQGTLVTVSS | 2322 | ARSLWLR GSFQH |
| COV096_HC_27-p1369 | 2325 | EVQLVESGGGLVQPGGSLRLSCAASGFTFSSYW MSWVRQAPGKGLEWVATIKQDGSEKYYVDSVK GRFTISRDNAKNSLYLQMNSLRAEDTAVYYCARG DYDFWSGYYDYWGQGTLVTVSS | 2326 | ARGDYDF WSGYYDY |
| COV096_HC_142-p1369 | 2329 | EVQLVESGGGLVQPGGSLRLSCAASRFTFSSYW MSWVRQAPGKGLEWVANIKQDGSEKYYVDSVK GRFTISRDNAKNSLYLQMNSLRAEDTAVYYCATA PWLRGGFDYWGQGTLVTVSS | 2330 | ATAPWLR GGFDY |
| COV096_Hc_1-p1369 | 2333 | EVQLVESGGGLVQPGRSLRLSCAASGFTFDDYA MHWVRQAPGKGLEWVSGVSWNSGTIGYADSV KGRFTISRDNAKNSLYLQMNSLRAEDTALYYCAKI ADIVRAYDFWSGQHFDAFDIWGQGTMVTVSS | 2334 | AKIADIVR AYDFWSG QHFDAFD I |
| COV096_HC_15-p1369 | 2337 | EVQLVESGGGLVQPGRSLRLSCAASGFTFDDYA MHWVRQAPGKGLEWVSGISWNSGIIGYADSV MGRFTISRDNAKNSLYLQMNSLRAEDTALYYCAK DGGSGTTEYEAYYFDYWGQGTLVTVSS | 2338 | AKDGGSG TTEYEAYY FDY |
| COV096_HC_20-p1369 | 2341 | EVQLVESGGGLVQPGRSLRLSCAASGFTFDDYA MHWVRQAPGKGLEWVSGISWNSGTIGYADSV QGRFIISRDNAKNSLYLQMNSLRAEDTALYYCAK DMGRDDSSGSLLFDYWGQGTLVTVSS | 2342 | AKDMGR DDSSGSLL FDY |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_HC_159-pl369 | 2345 | EVQLVESGGGLIQPGRSLRLSCAASGFTFDDYAMHWVRQAPGKGLEWVSGTSWNSGTIGYADSVKGRFTISRDNAKNSLYLQMNRLRAEDTALYHCAKDIGSKRSTSENYGMDVWGQGTTVTVSS | 2346 | AKDIGSKRSTSENYGMDV |
| COV096_HC_103-pl369 | 2349 | QLQLQESGPGLVKPSETLSLTCTVSGGSITSSSYYWGWIRQPPGKGLEWIGTIYYGGSTYYNPSLKSRVTISVDTSKNQISLKLSSVTAADTAVYYCASLRGAYYDFWSGPRDGGWFDPWGQGTLVTVSS | 2350 | ASLRGAYYDFWSGPRDGGWFDP |
| COV096_HC_23-pl369 | 2353 | QVQLQESGPGLVKPSQTLSLTCTVSGGSISSGSYYWSWIRQPAGKGLEWIGHIYTSGSTNYNPSLKSRVTISVDTSKNQFSLKLSSVTAADTAVYYCAREIPSTWYFDLWGRGTLVTVSS | 2354 | AREIPSTWYFDL |
| COV096_HC_101-pl369 | 2357 | QVQLQESGPGLVKPSQTLSLTCTVSGGSISSGNYYLTWIRQPAGKGLEWIGHIYTSGSTNYNPSLKSRVTISVDTSMNQFSLKLSSVTAADTAVYYCARDIPPTWYFDLWGRGTLVTVSS | 2358 | ARDIPPTWYFDL |
| COV096_HC_174-pl369 | 2361 | EVQLVQSGAEVKKPGESLKISCKGSGYSFTSHWIGWVRQMPGKGLEWMGIIYPGDSDTRYSPSFQGQVTISADKSISTAYLQWSSLKASDTAMYYCARLPSGRYNWFDPWGQGTLVTVSS | 2362 | ARLPSGRYNWFDP |
| COV096_HC_189-pl369 | 2365 | EVQLVQSGAEVKKPGESLKISCKGSGYSFTSYWIGWVRQMPGKGLEWMGIIYPGDSDTTYSPSFQGQVTISADKSVTTAYLQWSSLKASDTAMYYCARLPQEEKRFLEWLPPANVRKQIPYYYGMDVWGQGTTVTVSS | 2366 66 | ARLPQEEKRFLEWLPPANVRKQIPYYYGMDV |
| KAPPA | | | | |
| COV096_KC_100-pl389 | 2047 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 2048 | QQSYSTPPWT |
| COV096_KC_164-pl389 | 2051 | DIQMTQSPSSLSASVGDRVTLTCRASQSISSYLNWYQQKPGKAPNLLIYAASSLQSGVPSRFSGSGSGTDFTLTISSLQPEDFATYYCQQSYSAPPWTFGQGTKVEIK | 2052 | QQSYSAPPWT |
| COV096_KC_25-pl389 | 2055 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 2056 | QQSYSTPPWT |
| COV096_KC_91-pl389 | 2059 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 2060 | QQSYSTPPWT |
| COV096_KC_91-pl389 | 2063 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK | 2064 | QQSYSTPPWT |
| COV096_KC_115-pl389 | 2067 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK | 2068 | QQYDNLPRS |
| COV096_KC_133-pl389 | 2071 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK | 2072 | QQYDNLPRS |
| COV096_KC_34-pl389 | 2075 | DIQMTQSPSSLSASVGDRVTITCQASQDISNYLNWYQQKPGKAPKVLIYDASNLETGVPSRFSGSGSGTDFTFTISSLQPEDIATYFCQQYDNLPRSFGQGTKLEIK | 2076 | QQYDNLPRS |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_KC_34-p1389 | 2079 | DIQMTQSPSSLSASVGDRVTITCQASQDI SNYLNWYQQKPGKAPKVLIYDASNLETG VPSRFSGSGSGTDFTFTISSLQPEDIATYF CQQYDNLPRSFGQGTKLEIK | 2080 | QQY DNL PRS |
| COV096_KC_106-p1389 | 2083 | DIQMTQSPSSVSASVGDRVTITCRASQGI SSWLAWYQQKPGKAPKLLIYTASGLQSG VPSRFSGSGSETDFTLTISSLQPEDFATYY CQQTNSFPLTFGGGTKVEI | 2084 | QQT NSF PLT |
| COV096_KC_132-p1389 | 2087 | DIQMTQSPSSVSASVGDRVTITCRASQGI SSWLAWYQQKPGKAPKLLIYTASGLQSG VPSRFSGSGSETDFTLTISSLQPEDFATYY CQQTNSFPLTFGGGTKVEI | 2088 | QQT NSF PLT |
| COV096_KC_6-p1389 | 2091 | DIQMTQSPSSVSASVGDRVTITCRASQGI SSWLAWYQQKPGKAPKLLIYVESSLQSG VPSRFSGSGSGTDFTLTISSLQPEDFATYY CQQANSFPLTFGGGTKVEIK | 2092 | QQA NSF PLT |

LAMBDA

| COV096_LC_116-p1409 | 2095 | QSALTQPASVSGSPGQSITISCTGTSSDV GSYNLVSWYQQHPGKAPKLMIYEDSKR PSGVSNRFSGSKSGNTASLTISGLQAEDE ADYYCCSYAGSSTRLFGGGTKLTVL | 2096 | CSY AGS STRL |
| COV096_LC_77-p1409 | 2099 | QSXLTQPASVSGSPGQSITISCTGTSSDV GSYNLVSWYQQHPGKAPKLMIYEGSKR PSGVSNRFSGSKSGNTASLTISGLQAEDE ADYYCCSYAGSSTRVFGGGTKLTVL | 2100 | CSY AGS STR V |
| COV096_LC_138-p1409 | 2103 | SYXLTQPPSVSVAPGKTARITCGGNNIGS KSVHWYQQKPGHAPVLVVYDDSDRPSG IPERFSGSNSGNTATLTISRVEAGDEADY YCQVWDSTGGHPDVVFGGGTKLTVL | 2104 | QV WD STG GHP DVV |
| COV096_LC_176-p1409 | 2107 | SYXLTQPPSVSVAPGKTARITCGGNNIGS KSVHWYQQKPGQAPVLVVYDDSDRPS GIPERFSGSNSGNTATLTISRVEAGDEAD YYCQVWDSTSDHPDVVFGGGTKLTVL | 2108 | QV WD STS DHP DVV |
| COV096_LC_104-p1409 | 2111 | NFMLTQPHSVSESPGKTVTISCTRSSGSI ASNYVQWYQQRPGSAPTTVIYEDNQRP SGVPDRFSGSIDSSSNSASLTISGLKTEDE ADYYCQSYDSINWVFGGGTKLTVL | 2112 | QSY DSI NW V |
| COV096_LC_111-p1409 | 2115 | NFMLTQPHSVSESPGKTVTISCTRSSGSI ASNYVQWYQQRPGSAPTTVIYEDNERP SGVPDRFSGSIDSSSNSASLTISGLKTEDE ADYYCQSYDRINWVFGGGTKLTVL | 2116 | QSY DRI NW V |

KAPPA

| COV096_KC_158-p1389 | 2119 | EIVLTQSPATLSLSPGERATLSCRASQSVS SYLAWYQQKPGQAPRLLIYDASNRATGI PARFSGSGSGTDFTLTISSLEPEDFAVYC QQRSNWPRGFGQGTKVEIK | 2120 | QQR SN WP RG |
| COV096_KC_78-p1389 | 2123 | EIVLTQSPATLSLSPGERATLSCRASQSVS SYLAWYQQKPGQAPRLLIYDASNRATGI PARFSGSGSGTDFTLTISSLEPEDFAVYC QQRSNWPRGFGQGTKVEIK | 2124 | QQR SN WP RG |
| COV096_LC_130-p1409 | 2127 | SYXLTQPPSVSVAPGKTARITCGGNNIGS KSVHWYQQKPGQAPVLVVYDDSDRPS GIPERFSGSNSGNTATLTISRVEAGDEAD YYCQVWDSSSDPVVFGGGTKLTVL | 2128 | QV WD SSS DPV V |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_LC_44-pl409 | 2131 | SYVLTQPPSVSVAPGKTARITCGGNNIGS KSVHWYQQKPGQAPVLVVYDDSDRPS GIPERFSGSNSGNTATLTISRVEAGDEAD YYCQVWDSSSDPVVFGGGTKLTVL | 2132 | QV WD SSS DPV V |

KAPPA

| COV096_KC_72-pl389 | 2135 | DIQMTQSPSSLSASVGDRVTITCQASQDI SNYLNWYQQKPGKAPKLLIYDASNLETG VPSRFSGSGSGTDFTFTISSLQPEDIATYY CQQYDNLPLTFGGGTKVEIK | 2136 | QQY DNL PLT |
| COV096_KC_4-pl389 | 2139 | EIVLTQSPATLSLSPGERATLSCRASQSVS SYLAWYQQKPGQTPRLLIYDASNRATGI PARFSGSGSGTDFTLTISSLEPEDFAVYYC QQRSNWPPIAFGQGTRLEIK | 2140 | QQR SN WPP IA |
| COV096_KC_127-pl389 | 2143 | DIQMTQSPSSLSASVGDRVTITCRASQSI SSYLNWYQQKPGKAPKLLIYAASSLQSG VPSRFSGSGSGTDFTLTISSLQPEDFATYY CQQSYSTLWTFGQGTKVEIK | 2144 | QQS YSTL WT |
| COV096_KC_113-pl389 | 2147 | EIVLTQSPGTLSLSPGERATLSCRASQSVS SSYLAWYQQKPGQAPRLLIYGASSRATGI PDRFSGSGSGTDFTLTISRLEPEDFAVYYC QQYVSSPWTFGQGTKVEIK | 2148 | QQY VSS PWT |
| COV096_KC_153-pl389 | 2151 | DIQMTQSPSSLSASVGDRVTITCRASQSI SRYLNWYQQKSGKAPKLLIYAASSLQSG VPSRFSGSGSGTDFTLTISSLQPEDFATYY CQQSYSTPWTFGQGTKVEIK | 2152 | QQS YST PWT |
| COV096_KC_55-pl389 | 2155 | DIVMTQSPDSLAVSLGERATINCKSSQSV LYSSNNKNYLAWYQQKPGQPPKLLIYW ASTRESGVPDRFSGSGSGTDFTLTISSLQ AEDVAVYYCQQYYSTPCSFGQGTKLEIK | 2156 | QQY YST PCS |
| COV096_KC_42-pl389 | 2159 | DIVMTQSPDSLAVSLGERATINCKSSQSV LYSSNNKSYLAWYQQKPGQPPKLLIYWA STRESGVPDRFSGSGSGTDFTLTISSLQAE DVAVYYCQQYYSTLPLTFGGGTKVEIK | 2160 | QQY YSTL PLT |
| COV096_KC_156-pl389 | 2163 | DIQMTQSPSSLSASVGDRVTITCQASQDI SNYLNWYQQKPGKAPKLLIYDASNLETG VPSRFSGSGSGTDFTFTISSLQPEDIATYY CQQFDNLPITFGQGTRLEIK | 2164 | QQF DNL PIT |
| COV096_KC_137-pl389 | 2167 | DIQMTQSPSSLSASVGDRVTITCRASQSI SSYLNWYQQKPGKAPKLLIYAASSLQSG VPSRFSGSGSGTDFTLTISSLQPEDFATYY CQQSYSSPPITFGPGTKVDIK | 2168 | QQS YSSP PIT |
| COV096_KC_75-pl389 | 2171 | DIQMTQSPSSLSASVGDRVTITCRASQSI SSYLNWYQQKPGKAPKLLIYVASSLQSG VPSRFSGSGSGTDFTLTISSLQPEDFATYY CQQSYSTPPITFGQGTRLEIK | 2172 | QQS YST PPIT |
| COV096_KC_123-pl389 | 2175 | DIQMTQSPSSLSASVGDRVTITCRASQSI SSYLNWYQQKPGKAPNLLIYAASSLQSG VPSRFSGSGSGTDFTLTISSLQPEDFATYY CQQSYNTPQVTFGGGTKVESK | 2176 | QQS YNT PQV T |
| COV096_KC_65-pl389 | 2179 | DIQMTQSPSSLSASVGDRVTITCRASQSI SSYLNWYQQKPGKAPKLLIYAASSLQSG VPSRFSGGGSGADFTLTISSLQPEDFATY YCQQSYSTPPITFGQGTRLEIK | 2180 | QQS YST PPIT |
| COV096_KC_81-pl389 | 2183 | DIQMTQSPSSLSASVGDRVTITCRASQSI SSYLNWYQQKPGKAPKLLIYAASSLQSG VPSRFSGSGSGTDFTLTISSLQPEDFATYY CQQSYSTPPWTFGQGTKVEIK | 2184 | QQS YST PPW T |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_KC_166-pl389 | 2187 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK | 2188 | QQSYSTPLT |
| COV096_KC_140-pl389 | 2191 | DIQMTQSPSSLSASVGDRVTITCRASQDISSWLAWYQQKPGKAPKLLIYAASNLQSGVPSRFSGSGSGTHFTLTISSLQPEDFVTYYCQQANRFPITFGQGTRLEIK | 2192 | QQANRFPIT |
| COV096_KC_43-pl389 | 2195 | DIQMTQSPSSLSASVGDRVTITCQASQDIRNFLNWYQQKPGKAPKLLIYDASNLETGVPSRFSGSGSGTDFTFTISSLQPEDIATYYCQQYDNLPLTFGGGTKVEIK | 2196 | QQYDNLPLT |
| COV096_KC_21-pl389 | 2199 | DIQMTQSPSSLSASVGDRVTITCRASQSISSYLNWYQQKPGKAPKLLIYAAFSLQSGVPSRFSGSGSGTDFTLTISSLQPEDFATYYCQQSYSTPWTFGQGTKVEIK | 2200 | QQSYSTPWT |
| COV096_KC_122-pl389 | 2203 | DIQMTQSPSSLSASVGDRVTITCRASQSISSYLNWYQQKPGKAPKLLIYAASNLQSGVPSRFSGSGSGTDFTLTISSLQPEDFATYYCQQSYSSPPWTFGQGTKVEIK | 2204 | QQSYSSPPWT |
| COV096_KC_98-pl389 | 2207 | DIQMTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK | 2208 | QQSYSTPPWT |
| COV096_KC_48-pl389 | 2211 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPATFGQGTKVEIK | 2212 | QQSYSTPAT |
| COV096_KC_79-pl389 | 2215 | DIQMTQSPSSLSASVGDRVTITCRASQSISSYLNWYQQKPGKAPKLLIYGASSLQSGVPSRFSGSGSGTDFTLTISSLQPEDFATYYCQQSYSTPATFGQGTKLEIK | 2216 | QQSYSTPAT |
| COV096_KC_3-pl389 | 2219 | EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK | 2220 | QQYNNWWT |
| COV096_KC_3-pl389 | 2223 | EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK | 2224 | QQYNNWWT |
| COV096_KC_134-pl389 | 2227 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPQGTFGGGTKVEIK | 2228 | QQLNSYPQGT |
| COV096_KC_68-pl389 | 2231 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK | 2232 | QQLNSYPPA |
| COV096_KC_183-pl389 | 2235 | EIVLTQSPGTLSLSPGERATLSCRASQSFSSTYLAWYQQKPGQAPRLLIYGASSRATGIPDRFSGSGSGTDFTLTISRLEPEDFAVYYCQQYVTSPWTFGQGTKVEIK | 2236 | QQYVTSPWT |
| COV096_KC_74-pl389 | 2239 | EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK | 2240 | QQYNNWPRT |
| COV096_KC_45-pl389 | 2243 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPKLTFGGGTKVEIK | 2244 | QQYDNLPPKLT |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_KC_126-p1389 | 2247 | DIQMTQSPSSLSASVGDRVTIPCRASQNI DNYLNWYQQKPGKAPKLLIFAASGLQDE APSRFSGVGSGTDFTLTISSLQPEDSATYY CQQSYISPYTFGRGTKLEIK | 2248 | QQS YISP YT |
| COV096_KC_8-p1389 | 2251 | DIQMTQSPSSVSASLGDRVTITCRASQGI SSWLAWYQQKPGKAPKVLIYAASSLQSG VPSRFSGSGSGTDFTLTISSLQPEDFATYY CQQANSFPITFGQGTRLEIK | 2252 | QQA NSF PIT |
| COV096_KC_124-p1389 | 2255 | DIQMTQSPSSLSASVGDRVTITCRASQSI SSYLNWYQQKPGKAPKLLIYAASSLQSG VPSRFSGSGSGTDFTLTISSLQPEDFATYY CQQSYSTPCSFGQGTKLEIK | 2256 | QQS YST PCS |
| COV096_KC_28-p1389 | 2259 | AIQLTQSPSSLSASVGDRVTITCRASQGIS SALAWYQQKPGKAPKLLIYDASSLESGVP SRFSGSGSGTDFTLTISSLQPEDFATYYCQ QFNNFGPGTKVDIK | 2260 | QQF NN |
| COV096_KC_12-p1389 | 2263 | EIVMTQSPATLSVSPGERATLSCRASQSV SSNLAWYQQKPGQAPRLLIYGASTRATG IPARFSGSGSGTEFTLTISSLQSEDFAVYY CQQYNNWPPGGFTFGPGTKVDIK | 2264 | QQY NN WPP GGF T |

LAMBDA

| COV096_LC_90-p1409 | 2267 | SYVLTQPPSVSVSPGQTARITCSGEALPK QYAYWYQQKPGQAPVMVIYKDSERPSG IPERFSGSSSGTTVTLTISGVQAEDDADYY CQSADSSGTLVVFGGGTKLTVL | 2268 | QSA DSS GTL VV |
| COV096_LC_71-p1409 | 2271 | SYVLTQPPSVSVAPGKTARITCGGNNIGS KSVHWYQQKPGQAPVLVVYDDSDRPS GIPERFSGSNSGNTATLTISRVEAGDEAD YYCQVWDYGVVFAGGTKLTVL | 2272 | QV WD YGV V |
| COV096_LC_52-p1409 | 2275 | NFMLTQPHSVSESPGKTVTISCTRSSGSI ASNYVQWYQQRPGSAPTTVIYEDYQRP SGVPDRFSGSIDSSSNSASLTISGLKTEDE ADYYCQSYDSGVVFGGGTKLTVL | 2276 | QSY DSG VV |
| COV096_LC_10-p1409 | 2279 | QXXLTQPPSASGSPGQSVTISCTGTSSDV GGYNYVSWYQQHPGKAPKLMIYEVSKR PSGVPDRFSGSKSGNTASLTVSGLQAED EADYYCSSYAGSNNWVFGTGTKVTVL | 2280 | SSY AGS NN WV |
| COV096_LC_2-p1409 | 2283 | SYVLTQPPSVSVAPGKTARITCGGNNIGS KSVHWYQQKPGQAPVLVVYDDSDRPS GIPERFSGSNSGNTATLTISRVEAGDEAD YYCQVWDSSSDPYVFGTGTKVTVL | 2284 | QV WD SSS DPY V |
| COV096_LC_30-p1409 | 2287 | QSVLTQPPSVSGAPGQRVTISCTGSSSNI GAGYDVHWYQQLPGTAPKLLIYGNSNR PSGVPDRFSGSKSGTSASLAITGLQAEDE ADYYCQSYDSSLRGVFGGGTKLTVL | 2288 | QSY DSS LRG V |
| COV096_LC_136-p1409 | 2291 | QSXXTQPPSASASLGASVTLTCTLSSGYS NYKVDWYQQRPGKGPRFVMRVGTGGI VGSKGDGIPDRFSVLGSGLNRYLTIKNIQ EEDESDYHCGADQGSGSNFVGVFGGGT KLTVL | 2292 | GAD QGS GSN FVG V |
| COV096_LC_99-p1409 | 2295 | QSXXTQPPSVSGAPGQRVTISCTGSSSNI GAGYDVHWYQQLPGTAPKLLIYANINRP SGVPDRFSGSKSGTSASLAITGLQAEDEA DYYCQSYDSSLSGSVFGGGTKLTVL | 2296 | QSY DSS LSG SV |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_LC_152-pl409 | 2299 | QSVLTQPPSASGTPGQRVTISCSGSSSNI GSNYVYWYQQLPGTAPKLLIYRNNQRPS GVPDRFSGSKSGTSASLAISGLRSEDEAD YYCAAWDDSLSGYWVFGGGTKLTVL | 2300 | AAWDDSLSGYWV |
| COV096_LC_50-pl409 | 2303 | SYVLTQPPSVSVAPGKTARITCGGNNIGS KSVHWYQQKPGQAPVLVIYYDSDRPSGI PERFSGSNSGNTATLTISRVEAGDEADYY CQVWDSSSDHPVFGGGTKLTVL | 2304 | QVWDSSSDHPV |
| COV096_LC_92-pl409 | 2307 | QSVLTQEPSLTVSPGGTVTLTCGSSTGAV TSGHYPYWFQQKPGQAPRTLIYDTSNKH SWTPARFSGSLLGGKGALTLSGAQPEDE AEYYCLLSYSGARVFGGGTKLTVL | 2308 | LLSYSGARV |
| COV096_LC_40-pl409 | 2311 | SYVLTQPPSVSVAPGKTARITCGGNNIGS KSVHWYQQKPGQAPVLVIYYDTDRPSGI PERFSGSNSGNTATLTISRVEAGDEADYY CQVWDSSSALWVFGGGTKLTVL | 2312 | QVWDSSSALWV |
| COV096_LC_149-pl409 | 2315 | QXXXTQPASVSGSPGQSITISCTGTSSDV GGYNYVSWHQQHPGKAPKLMIYDVSN RPSGVSNRFSGSKSGNTASLTISGLQAED EADYYCSSYTSSSTLVFGGGTKLTVL | 2316 | SSYTSSSTLV |
| COV096_LC_157-pl409 | 2319 | NFMLTQPHSVSESPGKTVTISCTRSSGSI ASNYVQWYQQRPGSSPTMYEDNQRPS GVPDRFSGSIDSSSNSASLTISGLKTEDEA DYYCQSYDSSNVVFGGGTKLTVL | 2320 | QSYDSSNVV |
| COV096_LC_121-pl409 | 2323 | NFMLTQPHSVSESPGKTVTISCTRSSGSI ASNYVQWYQQRPGSSPTTVIYEDNQRP SGVPDRFSGSIDSSSNSASLTISGLKTEDE ADYYCQSYDSSSWVFGGGTKLTVL | 2324 | QSYDSSSWV |
| COV096_LC_27-pl409 | 2327 | SYXLTQPPSVSVSPGQTARITCSGDAFPN QYAYWYQQKPGQAPVLVIYKDSERPSGI PERFSGSSSGTTVTLTISGVQAEDEADYY CQSADSSSWVFGGGTKLTVL | 2328 | QSADSSSWV |
| COV096_LC_142-pl409 | 2331 | NFMLTQPHSVSESPGKTVTISCTRSSGSI ASNYVQWYQQRPGSSPTTVIYEDSQRPS GVPDRFSGSIDSSSNSASLTISGLKTEDEA DYYCQSFDSTNLWVFGGGTKLTVL | 2332 | QSFDSTNLWV |
| COV096_LC_1-pl409 | 2335 | QSALTQPPSASGTPGQRVTISCSGSSSNI GSNTVNWYQQLPGTAPKLLIYSNNQRPS GVPDRFSGSKSGTSASLAISGLQSEDEAD YYCAAWDDSLVVFGGGTKLTVL | 2336 | AAWDDSLVV |
| COV096_LC_15-pl409 | 2339 | QSVLTQPPSASGTPGQRVTISCSGSSSNI GSNTVNWYQQLPGTAPKLLIYSNNQRPS GVPDRFSGSKSGTSASLAISGLQSEDEAD YYCAAWDDSLNGVVFGGGTKLTVL | 2340 | AAWDDSLNGVV |
| COV096_LC_20-pl409 | 2343 | SYVLTQPPSVSVAPGKTARITCGGNNIGS KSVHWFQQKPGQAPVLVVYDDSDRPSG IPERFSGSNSGNTATLTISRVEAGDEADY YCQVWDSSSDHVVFGGGTKLTVL | 2344 | QVWDSSSDHV V |
| COV096_LC_159-pl409 | 2347 | SYVLTQPPSVSVAPGKTARITCGGNNIGS KSVHWYQQKPGQAPVLVVYDDSDRPS GIPERFSGSNSGNTATLTISKVEAGDEAD YYCQVWDSSSDSVVFGGGTKLTVL | 2348 | QVWDSSSDSV V |

TABLE 12-continued

Anti-SARS-CoV-2 IgG antibodies from COV96

| SEQUENCE_ID | SEQ ID NO | aa | SEQ ID NO | cdr3_aa |
|---|---|---|---|---|
| COV096_LC_103-pl409 | 2351 | QXXXTQPASVSGSPGQSITISCTGTSSDV GSYNLVSWYQQHPGKAPKLMIYEDSKR PSGVSNRFSGSKSGNTASLTISGLQAEDE ADYYCCSYAGSSLWVFGGGTKLTVL | 2352 | CSY AGS SLW V |
| COV096_LC_23-pl409 | 2355 | QSVLTQPPSASGTPGQRVTISCSGSSSNI GSNYVYWYQQLPGTAPKLLIYRNNQRPS GVPDRFSGSKSGTSASLAISGLRSEDEAD YYCAAWDDSLSGYWVFGGGTKLTVL | 2356 | AA WD DSL SGY WV |
| COV096_LC_101-pl409 | 2359 | SYVLTQPPSVSVAPGKTARITCGGNNIGS KNVHWYQQKPGQAPVLVVYDDSDRPS GIPERFSGSNSGNTATLTISRVEAGDEAG YYCQVWDSTSDHLFWVFGGGTKLTVL | 2360 | QV WD STS DHL FWV |
| COV096_LC_174-pl409 | 2363 | QSXXTQPPSASGTPGQRVTISCSGSSSNI GSNTVNWYQQLPGTAPKLLIYSNNQRPS GVPDRFSGSKSGTSASLAISGLQSEDEAD YYCAAWDDSLNGHVVFGGGTKLTVL | 2364 | AA WD DSL NGH VV |
| COV096_LC_189-pl409 | 2367 | QSXLTQPPSVSGAPGQRVTISCTGSSSNI GADYDVHWYQQLPGTAPKLLIYGNSNR PSGVPDRFSGSKSGTSASLAITGLQAEDE ADYYCQSYDSSLSGPYWVFGGGTKLTVL | 2368 | QSY DSS LSG PYW V |

TABLE 13

Anti-SARS-CoV-2 IgG antibodies from COV107

| SEQUENCE_ID | SEQ ID NO | aa | SEQ ID NO | cdr3_aa |
|---|---|---|---|---|
| HEAVY | | | | |
| COV107_Plate1_HC_9-P1369 | 2721 | EVQLVESGGGLIQPGGSLRLSCAASGFTVSSNY MSWVRQAPGKGLEWVSVIYSGGSTFYADSVKG RFTISRDNSKNTLYLQMNSLRAEDTAVYYCARD WGEYYFDYWGQGTLVTVSS | 2369 | ARDWG EYYFDY |
| COV107_Plate1_HC_36-P1369 | 2725 | EVQLVESGGGLIQPGGSLRLSCAASGFIVSSNYM SWVRQAPGKGLEWVSVIYSGGSTYYADSVKGR FTISRDNSKNTLYLQMNSLRVEDTAVYYCARDY GDYYFDYWGQGTLVTVSS | 2373 | ARDYGD YYFDY |
| COV107_Plate1_HC_40-P1369 | 2729 | EVQLVESGGGLIQPGGSLRLSCAASGFTVSSNY MSWVRQAPGKGLEWVSVIYSGGSTFYADSVKG RFTISRDNSKNTLYLQMNSLRAEDTAVYYCARD WGEYYFDYWGQGTLVTVSS | 2377 | ARDWG EYYFDY |
| COV107_Plate2_HC_13-P1369 | 2733 | EVQLVESGGGLIQPGGSLRLSCAASGFIVSSNYM SWVRQAPGKGLEWVSVIYSGGSTFYADSVKGR FTISRDNSKNTLYLQMNSLRAEDTAVYYCARDY GDYYFDYWGQGTLVTVSS | 2381 | ARDYGD YYFDY |
| COV107_Plate2_HC_93-P1369 | 2737 | EVQLVESGGGLIQPGGSLRLSCAASGFIVSSNYM SWVRQAPGKGLEWVSVIYSGGSTFYTDSVKGR FTISRDNSKNTLYLQMNSLRAEDTAVYYCVRDY GDFYFDYWGQGTLVTVSS | 2385 | VRDYGD FYFDY |
| COV107_Plate1_HC_11-P1369 | 2741 | QVQLQQWGAGLLKPSETLSLTCAVSGGSLSGFY WTWIRQPPGKGLEWIGETNHFGSTDYKASLKS RVTISVGMSRNQFSLKVTSLTAADTAVYYCARK PLLYSDFSPGAFDIWGQGTMIVVSS | 2389 | ARKPLLY SDFSPG AFDI |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_HC_42-P1369 | 2745 | QVQLQQWGAGLLKPSETLSLSCAVYGGSLSGYY WSWIRQPPGKGLEWIGEINHFGSTGYNPSLKSR VTISVDTSKSQFSVKLSSVTAADTAVYYCARKPLL YSNLSPGAFDIWGQGTMVTVSS | 2393 | ARKPLLY SNLSPG AFDI |
| COV107_Plate1_HC_84-P1369 | 2749 | QVQLQQWGAGLLKPSETLSLTCAVSGGSLSGFY WTWIRQPPGKGLEWIGETNHFGSTDYKPSLKS RVTISVDMSRNQFSLIMTSVTAADTAVYYCARK TLLFSDFSPGAFDIWGQGTMVVSS | 2397 | ARKTLLF SDFSPG AFDI |
| COV107_Plate2_HC_31-P1369 | 2753 | QVQLQQWGAGLLKPSETLSLTCAVSGGSLSGFY WTWIRQPPGKGLEWIGETNHFGSTDYKPSLKS RVTISVDMSRNQFSLKVTSVTAADTAVYYCARK PLLHSDLSPGAFDIWGQGTMVAVSS | 2401 | ARKPLL HSDLSP GAFDI |
| COV107_Plate2_HC_53-P1369 | 2757 | QVQLQQWGAGLLKPSETLSLTCAVSGGSLSGFY WTWIRQPPGKGLEWIGETNHFGSTGYKPSLKS RVTISVDMSRNQFSLKVTSVTAADTAVYYCARK PLLYSDFSPGAFDIWGQGTMVAVSS | 2405 | ARKPLLY SDFSPG AFDI |
| HEAVY | | | | |
| COV107_Plate1_HC_29-P1369 | 2761 | EVQLVESGGGLIQPGGSLRLSCAASGFTVSSNY MSWVRQAPGKGLEWVSVIYSGGSTYYADSVK GRFTISRDNSKNTLYLQMHSLRAEDTAVYYCAR GEGWDLPYDYWGQGTLVTVSS | 2409 | ARGEG WDLPY DY |
| COV107_Plate1_HC_35-P1369 | 2765 | EVQLVESGGGLIQPGGSLRLSCAASGFTVSSNY MSWVRQAPGKGLEWVSVIYTGGSTFYADSVK GRFTISRDNSKNTLYLQMNSLRAEDTAMYYCAR GEGWDLPYDYWGQGTLVTVSS | 2413 | ARGEG WDLPY DY |
| COV107_Plate2_HC_4-P1369 | 2769 | EVQLVESGGGLIQPGGSLRLSCAASGFTVSSNY MSWVRQAPGKGLEWVSVIYSGGSTYYADSVK GRFTISRDNSKNTLYLQMNSLRAEDTAVYYCAR GEGWELPYDYWGQGTLVTVSS | 2417 | ARGEG WELPYD Y |
| COV107_Plate1_HC_63-P1369 | 2773 | QVQLVQSGAEVKKPGASVRVSCKASGYTFTSYG FSWVRQAPGQGLEWMGWISAYNGNTNFAQK LQGRVTMTTDTSTSTAYMELRSLRSDDTAVYYC ARGEAVAGTTGFFDYWGQGTLVTVSS | 2421 | ARGEAV AGTTGF FDY |
| COV107_Plate1_HC_68-P1369 | 2777 | QVQLVQSGAEVKKPGASVRVSCKASGYTFTSYG FSWVRQAPGQGLEWMGWISAYNGNTNFAQK LQGRVTMTTDTSTSTAYMELRSLRSDDTAVYYC ARGEAVAGTTGFFDYWGQGTLVTVSS | 2425 | ARGEAV AGTTGF FDY |
| COV107_Plate1_HC_13-P1369 | 2781 | QVQLVQSGAEVKKPGASVKVSCKASGYTFTDYY IHWVRQAPGQGLEWMGWINPNSGGTNYAQK FQGRVTMTRDTSISTAYMELSRLRSDDTAVYYC ARDVIVSMVRGVIFRMDVWGQGTTVTVSS | 2429 | ARDVIV SMVRG VIFRMD V |
| COV107_Plate1_HC_27-P1369 | 2785 | QVQLVQSGAEVKKPGASVKVSCKASGYTFTGYY MHWVRQAPGQGLEWMGWINPNSGGTNYA QKFQGRVTMTRDTSISTAYMELSRLRSDDTAVY YCATAHPRRIQGVFFLGPGVWGQGTTVTVSS | 2433 | ATAHPR RIQGVF FLGPGV |
| COV107_Plate1_HC_79-P1369 | 2789 | QVQLVQSGAEVKKPGASVKVSCKASGYTFTSYY MHWVRQAPGQGLEWMGIINPSGGTSYAQKL QGRVTMTRDTSTSVYMELSSLRSEDTAVYYCA RANHETTMDTYYYYYMDVWGKGTTVTVSS | 2437 | ARANHE TTMDTY YYYYM DV |
| COV107_Plate1_HC_91-P1369 | 2793 | QVQLVQSGAEVKKPGASVKVSCKASGYTFTSYY MHWVRQAPGQGLEWMGIINPSGGTSYAQKL QGRVTMTRDTSTSVYMELSSLRSEDTAVYYCA RANHETTMDTYYYYYMDVWGKGTTVTVSS | 2441 | ARANHE TTMDTY YYYYM DV |
| HEAVY | | | | |
| COV107_Plate1_HC_53-P1369 | 2797 | QMQLVQSGPEVKKPGTSVKVSCKASGFTFTSSA VQWVRQARGQRLEWIGWIVGSGNTNYVQK FQERVTITRDMSTSTAYMELSSLRSEDTAVYYCA APHCSSTSCFDAFDIWGQGTMVTVSS | 2445 | AAPHCS STSCFD AFDI |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_HC_81-P1369 | 2801 | QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCSDAFDIWGQGTMVTVSS | 2449 | AAPYCSGGSCSDAFDI |
| | | HEAVY | | |
| COV107_Plate2_HC_42-P1369 | 2805 | QVQLVESGGGLVQPGRSLRLSCAASGFTFSTYAMHWVRQAPGKGLKWVAVISYDGGNKYYADSVKGRFTISRDNSKNTLYLQMNSLRAEDTAVYYCARDPIWFGELLSPPFVHFDYWGQGTLVTVSS | 2453 | ARDPIWFGELLSPPFVHFDY |
| COV107_Plate2_HC_89-P1369 | 2809 | QVQLVESGGGVVQPGRSLRLSCAASGFTFSTYAMHWVRQAPGEGLEWVAVISYDGSNTYYADSVKGRFTISRDNSKNTLYLQMNSLRAEDTAVYYCARDPIWFGELLSPPFVHFDYWGQGTLVTVSS | 2457 | ARDPIWFGELLSPPFVHFDY |
| COV107_Plate1_HC_22-P1369 | 2813 | QVQLVESGGGVVQPGRSLRLSCAASGFTFSSHAMHWVRQAPGKGLEWVAVISYDGSNKYYADSVKGRFTISRDNSKNTLYLQMNSLRAEDTAVYYCAREDYYDSSGSFDYWGQGTLVTVSS | 2461 | AREDYYDSSGSFDY |
| COV107_Plate2_HC_88-P1369 | 2817 | QVQLVESGGGVVQPGRSLRLSCAASGFTFSRHAMHWVRQAPGKGLEWVAVISYDGSNKYYADSVKGRFTISRDNSKNTLYLQMNSLRAEDTAVYYCAREDYYDSSGSFDYWGQGTLVTVSS | 2465 | AREDYYDSSGSFDY |
| COV107_Plate2_HC_49-P1369 | 2821 | QVQLVESGGGVVQPGRSLRLSCAASGFTFSNYAMHWVRQAPGKGLEWVAVISYDGSNXYYADSVKGRFTISRDNSKNTLYLQMNSLRAEDTAIYYCASGYTGYDYFVRGDYYGLDVWGQGTTVTVSS | 2469 | ASGYTGYDYFVRGDYYGLDV |
| COV107_Plate2_HC_84-P1369 | 2825 | QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGYTGYDYFVGGDYYGMDVWGQGTTVTVSS | 2473 | ASGYTGYDYFVGGDYYGMDV |
| | | HEAVY | | |
| COV107_Plate1_HC_19-P1369 | 2829 | QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS | 2477 | ARGVNPDDILTGVDAFDI |
| COV107_Plate1_HC_38-P1369 | 2833 | QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS | 2481 | ARGVNPDDILTGVDAFDI |
| COV107_Plate2_HC_15-P1369 | 2837 | EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS | 2485 | TRWDGWSQHDY |
| COV107_Plate2_HC_69-P1369 | 2841 | EVQLVESGGGLIKPGRSLRLSCTASGFTFGDYAMTWFRQAPGKGLEWVGFIRSKAYGGTTGYAASVRYRFTISRDDSSGIAYLQMDSLKTEDTAVYYCTRWDGWSQHDYWGQGTLVTVSS | 2489 | TRWDGWSQHDY |
| COV107_Plate2_HC_32-P1369 | 2845 | EVQLVESGGGLIQPGGSLRLSCAASGFTVSSNYMTWVRQAPGKGLEWVSLIYPGGSTYYADSVKGRFTISRDNSKNTLYLQMNSLRAEDTAVYYCAREGMGMAAAGTWGQGTLVTVSS | 2493 | AREGMGMAAAGT |
| COV107_Plate2_HC_73-P1369 | 2849 | EVQLVESGGGLIQPGGSLRLSCAASGFTVSSNYMSWVRQAPGKGLEWVSLIYPGGSTYFADSVKGRFTISRDNSKNTLYLQMNSLRAEDTAVYYCAREGMGIAAAGTWGQGTLVTVSS | 2497 | AREGMGIAAAGT |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| HEAVY | | | | |
| COV107_Plate1_HC_62-P1369 | 2853 | EVQLVESGGGLIQPGGSLKLSCVVSGFTVSKNYI SWVRQAPGKGLEWVSVIFAGGSTFYADSVKGR FAISRDNSNNTLFLQMNSLRVEDTAIYYCARGD GELFFDHWGQGTLVTVSS | 2501 | ARGDGE LFFDH |
| COV107_Plate1_HC_73-P1369 | 2857 | EVQLVESGGGLIQPGGSLKLSCVVSGFTVSKNYI SWVRQAPGKGLEWVSVIFAGGSTFYADSVKGR FAISRDNSNNTLFLQMNSLRVEDTAIYYCARGD GELFFDQWGQGTLVTVSS | 2505 | ARGDGE LFFDQ |
| COV107_Plate1_HC_46-P1369 | 2861 | QVQLQESGPGLVKPSGTLSLTCAVSGGSISSTN WWSWVRQPPGKGLEWIGEIYHTGSTNYNPSL KSRVTISVDKSKNQFSLKLSSVTAADTAVYYCVR DGGRPGDAFDIWGQGTMVTVSS | 2509 | VRDGGR PGDAFD I |
| COV107_Plate2_HC57-P1369 | 2865 | QVQLQESGPGLVKPSGTLSLTCAVSGGSISSTN WWSWVRQPPGKGLEWIGEIYHTGSTNYNPSL KSRVTISVDKSKNQFSLKLSSVTAADTAVYYCVR DGGRPGDAFDIWGQGTMVTVSS | 2513 | VRDGGR PGDAFD I |
| COV107_Plate2_HC_36-P1369 | 2869 | QVQLQESGPGLVKPSETLSLTCTVSGGSISNYYW SWIRQPPGKGLEWIGYIYYSGSTNYNPSLKSRVT ISVDTSKNQFSLKLSSVTAADTAVYYCARVEDW GYCSSTNCYSGAFDIWGQGTMVTVSS | 2517 | ARVED WGYCSS TNCYSG AFDI |
| COV107_Plate2_HC71-P1369 | 2873 | QVQLQESGPGLVKPSETLSLTCTVSGGSISSYYW SWIRQPPGKGLEWIGYIYYSGSTNYNPSLKSRVT ISVDTSKNQFSLKLSSVTAADTAVYYCARVEDW GYCSSTNCYSGAFDIWGQGTMVTVSS | 2521 | ARVED WGYCSS TNCYSG AFDI |
| COV107_Plate1_HC_77-P1369 | 3220 | QVQLQESGPGLVKPSETLSLTCTVSGASVSSGSY YWSWIRQPPGKGLEWIGYIYYSGSTNYNPSLKS RVTISVDTSKNQFSLKLSSVTAADTAVYYCARER PGGTYSNTWYTPTDTNWFDTWGQGTLVTVSS | 2525 | ARERPG GTYSNT WYTPTD TNWFD T |
| COV107_Plate2_HC_72-P1369 | 3221 | QVQLQESGPGLVKPSETLSLTCTVSGASVSSGSY YWSWIRQPPGKGLEWIGYIYYSGSTNYNPSLKS RVTISVDTSKNQFSLKLSSVTAADTAVYYCARER PGGTYSNTWYTPTDTNWFDTWGQGTLVTVSS | 2529 | ARERPG GTYSNT WYTPTD TNWFD T |
| HEAVY | | | | |
| COV107_Plate1_HC_75-P1369 | 3222 | EVQLVQSGAEVKKPGESLKISCKGSGYRFTSYWI GWVRQMPGKGLEWMGIIYPGDSDATYSPSFQ GQVTISADRSISTAYLQWSSLKASDTAMYYCAR SFRDDPRIAVAGPADAFDIWGQGTMVTVSS | 2533 | ARSFRD DPRIAV AGPADA FDI |
| COV107_Plate2_HC_90-P1369 | 3223 | EVQLVQSGAEVKKPGESLKISCKGSGYSFTSYWI GWVRQMPGKGLEWMGIIYPGDSDTRYSPSFQ GQVTISADKSISTAYMQWSSLKASDTAMYYCA RSFRDDPRIAVAGPADAFDIWGQGTMVTVSS | 2537 | ARSFRD DPRIAV AGPADA FDI |
| HEAVY | | | | |
| COV107_Plate1_HC_52-P1369 | 3224 | QVQLVQSGAEVKKPGASVKVSCKASGYTFTSYG FSWVRQAPGQGLEWLGWISAYNGNTNYAQKL QGRVTMTTDTSTSTAYMELRSLRSDDTAVYYCA RAIAVAGTSGEFDYWGQGTLVTVSS | 2541 | ARAIAV AGTSGE FDY |
| COV107_Plate1_HC_58-P1369 | 3225 | QVQLVQSGAEVKKPGASVKVSCKASGYTFTSYG ISWVRQAPGQGLEWMGWISAYNGNTNYAQK LQGRVTMTTDTSTSTAYMELRSLRSDDTAVYYC ARSQGWLQLNDYWGQGTLVTVSS | 2545 | ARSQG WLQLN DY |
| COV107_Plate2_HC_45-P1369 | 3226 | QVQLVQSGAEVKKPGASVKVSCKASGYTFTGYY MHWVRQAPGQGLEWMGWINPNSGGTKYAQ KFQGRVTMTRDTSISTAYMELSRLRSDDTAVYY CARGHDYVWGSYRYHNVWGQGTLVTVSS | 2549 | ARGHDY VWGSY RYHNV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_HC_60-P1369 | 3227 | QVQLVQSGAEVKKPGASVMLSCKASGYTFTGY YMHWVRQAPGQGLEWMGWINPNSGGTNYA QKFQGRVTMTRDTSITTTYMELSRLRSDDTAVY YCARDLAFSMVRAPGDYWGQGTLVTVSS | 2553 | ARDLAF SMVRAP GDY |
| COV107_Plate1_HC_5-P1369 | 3228 | QVQLVQSGAEVKKPGASVKVSCKASGYTFTGYS MHWVRQAPGQGLEWMGWINPNSGGTNYA QKFQGRVTMTRDTSISTAYMELNRLRSDDTAV YYCARELIAVAGIFDYWGQGTLVTVSS | 2557 | ARELIAV AGIFDY |
| COV107_Plate2_HC_94-P1369 | 3229 | QVQLVQSGAEVKKPGASVKVSCKASGYTFTGYY MHWVRQAPGQGLEWMGWISPVSGGTNYAQ KFQGRVTMTRDTSISTAYMELSRLRSDDTAVYY CARAPLFPTGVLAGDYYYYGMDVWGQGTTVT VSS | 2561 | ARAPLF PTGVLA GDYYYY GMDV |
| COV107_Plate1_HC_83-P1369 | 3230 | QVQLVQSGAEVKKPGASVKVSCKASGYILTDYFI HWVRQAPGQGLEWMGWINPNSGGTNYAQK FQGRVTMTRDTSISTAYMELSRLRSDDTAVYHC ARYKGTTVNTNYYYGMDVWGQGTTVTVSS | 2565 | ARYKGT TVNTNY YYGMD V |
| COV107_Plate2_HC_40-P1369 | 3231 | QVQLVQSGAEVKKPGASVKVSCKASGYSFTSYY MHWVRQAPGQGLEWMGIINPSGGSTSYAQKF QGRVTMTRDTSTSTVYMELSSLRSEDTAVYYCA RDPSPIIARPGMGYWFDPWGQGTLVTVSS | 2569 | ARDPSPI IARPGM GYWFD P |
| COV107_Plate1_HC_28-P1369 | 3232 | QVQLVQSGAEVKKPGSSVKVSCKASGGTFRSYA ISWVRQAPGQGLEWMGGIIPIFGTTNYAQKFQ GRVTITADESTSRAYMELSSLRSEDTAVYYCARD SSGYYYVSNWFDPWGQGTLVTVSS | 2573 | ARDSSG YYYVSN WFDP |
| COV107_Plate2_HC_92-P1369 | 2929 | QVQLLESGGGLVKPGGSLRLSCAASGFTFSDYY MSWIRQAPGKGLEWVSYISSRSSYTNYADSVKG RFTISRDNAKNSLYLQMNSLRAEDTAVYYCATY RSYLPLVQVDYWGQGTLVTVSS | 2577 | ATYRSYL PLVQVD Y |
| COV107_Plate2_HC_55-P1369 | 2933 | EVQLVESGGGLVKPGGSLRLSCAASGFTFSSYS MNWVRQAPGKGLEWVSSISSSSSYIYYADSVKG RFTISRDNAKNSLYLQMNSLRAEDTAVYYCARG QLLPFADYWGQGTLVTVSS | 2581 | ARGQLL PFADY |
| COV107_Plate2_HC_47-P1369 | 2937 | EVQLVESGGGLVKPGGSLRVSCAASGFTFSSYS MNWVRQAPGKGLEWVSSISSSKNYIYYADSVK GRFTISRDNAKNSLYLQMNSLRAEDTAVYYCTR GSRGYYDRSGYYTPLDPYYGMDVWGQGTTVT VSS | 2585 | TRGSRG YYDRSG YYTPLDP YYGMD V |
| COV107_Plate1_HC_49-P1369 | 2941 | EVQLLESGGGLVQPGGSLRLSCAASGFTFSSYA MSWVRQAPGKGLEWVSGISDSGGSTYYADSV KGRFTISRDNSKNTLYLQMNSLRAEDTAVYYCA KEEVLPAVEYFQHWGQGTLVTVSS | 2589 | AKEEVL PAVEYF QH |
| COV107_Plate2_HC_22-P1369 | 2945 | QVQLVESGGGVVQPGRSLRLSCAASGFTFSSYG MHWVRQAPGKGLEWVAVISYDGSNKYYADSV KGRFTISRDNSKNTLDLQMNSLRAEDTAVYYCA KGGYYYNSDSYQAEIDYWGQGTLVTVSS | 2593 | AKGGYY YYNSDS YQAEID Y |
| COV107_Plate2_HC_91-P1369 | 2949 | QVQLVESGGGVVQPGRSLRLSCAASGFTFSSG MHWVRQAPGKGLEWVAIISYDGSNKYYADSV KGRFTISRDNSKNTLSLQMNSLRAEDTAVYYCA KDPLPFRDFFYYYMDVWGKGTTVTVSS | 2597 | AKDPLP FRDFFYY YMDV |
| COV107_Plate2_HC_35-P1369 | 2953 | QVQLVESGGGVVQPGRSLRLSCAASGFTFSSYA MHWVRQAPGKGLEWVAVISYDGSNKYYADSV KGRFTISRDNSKNTLYLQMNSLRAEDTAVYYCA RETQGGYYGSGSYYASPFDPWGQGTLVTVSS | 2601 | ARETQG GYYGSG SYYASPF DP |
| COV107_Plate2_HC_24-P1369 | 2957 | QVQLVESGGGVVQPGRSLRLSCAASGFTFSSYA MHWVRQAPGKGLEWVAVISYDGSNKYYADSV KGRFTISRDNSKNTLYLQMNSLRAEDTAVYYCA RDFYHNWFDPWGQGTLVTVSS | 2605 | ARDFYH NWFDP |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_HC_34-P1369 | 2961 | QVQLVESGGGVVQPGRSLRLSCAASGLTFSSYG MHWVRQAPGKGLEWVAVIWYDGINKYYADS VKGRFTISRDNSKNTLYLQMNSLRAEDTAVYYC ARDRGLRLGGPKYYFDYWGQGTLVTVSS | 2609 | ARDRGL RLGGPK YYFDY |
| COV107_Plate1_HC_41-P1369 | 2965 | EVQLVESGGGLVQPGGSLRLSCAASGFTFSSYY MNWVRQAPGKGLEWVSYISSSSSTIYYADSVK GRFTISRDNAKNSLYLQMNSLRDEDTAVYYCAR DPQRDPADYFDYWGQGTLVTVSS | 2613 | ARDPQR DPADYF DY |
| COV107_Plate2_HC_46-P1369 | 2969 | EVQLVESGGGLVQPGGSLRLSCAASGFTFSSYW MSWVRQAPGKGLEWVANIKQDGSEKYYVDSV KGRFTISGDNAKNSLYLHMNSLRAEDTAVYYCAI QLWLRGGYDYWGQGTLVTVSS | 2617 | AIQLWL RGGYDY |
| COV107_Plate1_HC_32-P1369 | 2973 | EVQLVESGGGLVQPGGSLRLSCADSGFTFSSYW MSWVRQAPGKGLEWVANIKQDGSEKYYVDSV KGRFTISRDNAKNSLYLQMNSLRAEDTAVYYCA VQLWLRGNFDYWGQGTLVTVSS | 2621 | AVQLW LRGNFD Y |
| COV107_Plate2_HC_25-P1369 | 2977 | EVQLVESGGGLVQPGRSLRLSCAASGFTFDDYA MHWVRQAPGKGLEWVSGISWNSGSRGYADS VKGRFTISRDNAKNSLYLLMNSLRAEDTAFYYCA KDDREGFGDYFDYWGQGTLVTVSS | 2625 | AKDDRE GFGDYF DY |
| COV107_Plate2_HC_54-P1369 | 2981 | EVQLVESGGGLVQPGRSLRLSCAASGFTFDDYA MHWVRQAPGKGLEWVSGISWNSGSIGYADSV KGRFTISRDNAKSSLYLQMKSLRVEDTALYYCAK DSLVRRNFYYYYMDVWGKGTTVTVSS | 2629 | AKDSLV RRNFYY YYMDV |
| COV107_Plate2_HC_20-P1369 | 2985 | QLQLQESGPGLVKPSETLSLTCTVSGGSISSSSYY WGWIRQPPGKGLEWIGSIYYSGSTYYNPSLKSR VTISVDTSKNQFSLKLSSVTAADTAVYYCAGMYY DILTGYSEGAFDIWGQGTMVTVSS | 2633 | AGMYY DILTGYS EGAFDI |
| COV107_Plate1_HC_25-P1369 | 2989 | QLQLQESGPGLVKPSETLSLTCTVSGGSISSSSYY WGWIRQPPGKGLEWIGSIYYSGSTYYNPSLKSR VTISVDTSKNQFSLKLSSVTAADTAVYYCAGGTN PQWLDSTFDYWGQGTLVTVSS | 2673 | AGGTNP QWLDS TFDY |
| COV107_Plate1_HC_64-P1369 | 2993 | QLQLQESGPGLVKPSETLSLTCTVSGGSISSSHY WGWIRQPPGKGLEWIGTIYYSGSTYYNPSLKSR VTISVDTSKNQFSLRLSSVTAADTAVYYCASAPYL NWNDWIFDYWGQGTLVTVSS | 2641 | ASAPYL NWND WIFDY |
| COV107_Plate2_HC_28-P1369 | 2997 | QVQLQESGPGLVKPSETLSLSCAVSGGSIGSYF WSWIRQPPGKGLEWIGYLHYSGSTNYNPSLKSR VTISVDTSKNQFSLKLSSVTAADTAVYYCARLQ WLRGAFDIWGQGTMVTVSS | 2645 | ARLQWL RGAFDI |
| COV107_Plate2_HC_58-P1369 | 3001 | QVQLQESGPGLVKPSETLSLTCTVSGGSISGYYW SWIRQPPGKGLEWIGYIYYSGSTNYNPSLKSRVT ISVDTSKNQFSLKLSSVTAADTAVYYCARYGWG YDSSGYYFDYWGQGTLVTVSS | 2649 | ARYGW GYDSSG YYFDY |
| COV107_Plate2_HC_2-P1369 | 3005 | QVQLQESGPRLVKPSENLSLTCTVSGGSISSYYW SWIRQPPGKGLEWIGYIYYTGSTKYNPSLKSRVTI SVDTSKNQFSLKLSSVTAADTAVFYCARATTPFS GVDYWGQGTLVTVSS | 2653 | ARATTP FSGVDY |
| COV107_Plate2_HC_10-P1369 | 3009 | QVQLQESGPGLVKPSETLSLTCTVSGGSISNYYW SWIRQPPGKGLEWIGYIYYSGSTNYNPSLKSRVT ISVDTSKNQFSLKLTSVTAADTAVYYCARILRGV AENWFDPWGQGTLVTVSS | 2657 | ARILRGV AENWF DP |
| COV107_Plate1_HC_48-P1369 | 3013 | QVQLQESGPGLVKPSETLSLTCTVSGGSVSSGSY YWSWIRQPPGKGLEWIGYIYYSGSTNYNPSLKS RVTISVDTSKNQFSLKLSSVTAADTAVYYCATRG GYYDSSGYYALAFDIWGQGTMVTVSS | 2661 | ATRGGY YDSSGY YALAFDI |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_HC_87-P1369 | 3017 | EVQLVQSGAEVKQPGESLKISCKALGYTFTTSWI SWVRQMPGKGLEWMGRIDPSDSYTKYSPSFQ GHVTISVDKSITTAYLQWSSLKASDSAVYYCATE TNSETTDMFTGYSFDPWGQGTLVTVSS | 2665 | ATETNS ETTDMF TGYSFD P |
| COV107_Plate2_HC_1-P1369 | 3021 | EVQLVQSGAEVKKPGESLKISCKGSGYRFTSYWI AWVRQMPGKGLEWMGIIYPGDSDTRYSPSFQ GQVTISADQSISTAYLQWSSLKASDTAMYYCAR GGPPGGVKLELTDYWGQGALVTVSS | 2669 | ARGGPP GGVKLE LTDY |
| COV107_Plate1_HC_92-P1369 | 3025 | EVQLVQSGAEVKKPGESLKISCKGSGYSFTSYWI GWVRQMPGKGLEWMGILYPGDSDTTYSPSFQ GQVTISADKSISTAYLQWSSLKASDTAMYYCARL HPTYYDILTGYYIDYWGQGTLVTVSS | 2673 | ARLHPT YYDILTG YYIDY |
| COV107_Plate1_HC_26-P1369 | 3029 | EVQLVQSGAEVKKPGESLKISCKGSGYSFISYWI GWVRQMPGKGLEWMGIIYPGDSDTRYSPSFQ GQVTISADKSISTAYLQWSSLKASDTAMYYCAR RPSSYSGWFDPWGQGTLVTVSS | 2677 | ARRPSS YSGWF DP |

HEAVY

| COV107_Plate2_HC_18-P1369 | 3033 | QVQLVQSGAEVKKPGASVKVSCKASGYTFTGYY MHWVRQAPGQGLEWMGWINPNSGGTNYA QKFQGRVTMTRDTSISTAYMELSRLRSDDTAVY YCAREPQINPYYDILTGYRAFDYWGQGTLVTVS S | 2681 | AREPQI NPYYDIL TGYRAF DY |
| COV107_Plate1_HC_21-P1369 | 3037 | QVQLVQSGAEVVRPGASVKVSCKASGYTFTTHY MHWVRQAPGQGLEWMGIINPSVGSTSYAQKF QGRVTMTRDTSTSTVYMELSSLISEDTAMYYCA RGPRSPSDWCSGGSCYDDQNWFDPWGQGTL VTVSS | 2685 | ARGPRS PSDWCS GGSCYD DQNWF DP |
| COV107_Plate1_HC_24-P1369 | 3041 | QVQLVQSGAEVMKPGASVKVSCKASGYTFTSY YMHWVRQAPGQGLEWMGIINPTAGSTSYAQK FQGRVTMTRDTSTSTVYMELSSLRSEDTAVYYC ARDFELWFGELRGWFDPWGQGTLVTVSS | 2689 | ARDFEL WFGELR GWFDP |
| COV107_Plate2_HC_17-P1369 | 3045 | QVQLVQSGAEVKKPGSSVKVSCKASGGTFSIYAI SWVRQAPGQGLEWMGGIIPILGTANYAQKFQ GRVTITADESTSTAYMELSSLRSEDTAVYYCASF HVAYGDYIPFDYWGQGTLVTVSS | 2693 | ASFHVA YGDYIPF DY |
| COV107_Plate1_HC_78-P1369 | 3049 | QVQLVQSGAEVKKSGSSVKVSCKASGGTFSSYG ISWVRQAPGQGLEWMGGIIPIIGTANYAQKFQ GRVTITADESMSTAYMELSSLRSEDTAVYYCAR AGLLTKNIVATIGCFDPWGQGTLVTVSS | 2697 | ARAGLL TKNIVA TIGCFDP |
| COV107_Plate1_HC_95-P1369 | 3053 | QVQLVQSGAEVKKPGASVKVSCKASGYTFTSYD INWVRQATGQGLEWMGWMNPNSGNTGYA QKFQGRVTMTRNTSISTAYMELSSLRSEDTAVY YCARGGRYCSSTSCYSHVGFDPWGQGTLVTVS S | 2701 | ARGGRY CSSTSCY SHVGFD P |
| COV107_Plate2_HC_38-P1369 | 3057 | EVQLVESGGGLVQPGGSLRLSCAASGFTFSNYD MHWVRQATGRGLEWVSTIGTAGDTYYPGSVK GRFTISRENAKNSLYLQMNSLRAGDTALYYCAR VRYDSSGYFWSLDYWGQGTLVTVSS | 2705 | ARVRYD SSGYFW SLDY |
| COV107_Plate2_HC_61-P1369 | 3061 | EVQLVESGGGLVQPGGSLRLSCAASGFTFSSYD MHWVRQATGKGLEWVSTIGTAGDTYYPGSVK GRFTISRENAKNSLYLQMNSLRAGDTAVYFCAR GVSGVVRGVIRSFYYYGLDVWGQGTTVTVSS | 2709 | ARGVSG VVRGVI RSFYYY GLDV |
| COV107_Plate1_HC_80-P1369 | 3065 | EVQLLESGGGLVQPGGSLRLSCAASGITFSSYAM TWVRQAPGKGLEWVSTISGSGGGTYYADSVKG RFTISRDNSKNTLYLQMNSLRAEDTAVYYCVET NLWFGEDNYYYYYGMDVWGQGTTVTVSS | 2713 | VETNLW FGEDNY YYYYGM DV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_HC_68-P1369 | 3069 | QVQLVESGGGVVQPGRSLRLSCAASGFTFSSYG MHWVRQAPGKGLEWVAVISYDGSNKYYADSV KGRFTISRDNSKNTLYLQMNSLRAEDTAVYYCA TGGGSYFSPRIYFDYWGQGTLVTVSS | 2717 | ATGGGS YFSPRIY FDY |
| COV107_Plate2_HC_51-P1369 | 3073 | QVQLVESGGGVVQPGRSLRLSCAASGFTFSSYG MHWVRQAPGKGLEWVAVISYDGSNKYYADSV KGRFTISRDNSKNTLYLQMNSLRAEDTAVYYCA KQAGPYCSGGTCYPGTLDYWGQGTLVTVSS | 3191 | AKQAGP YCSGGT CYPGTL DY |
| COV107_Plate1_HC_43-P1369 | 3077 | QVQLVESGGGVVQPGRSLRLSCAASGFTFSSYG MHWVRQAPGKGLEWVAVISYDGSNKYYADSV KGRFTISRDNSKNTLYLQMNSLRAEDTAVYYCA KAGYSYGYPQQYFDYWGQGTLVTVSS | 3192 | AKAGYS YGYPQQ YFDY |
| COV107_Plate2_HC_3-P1369 | 3081 | QVQLVESGGGVVQPGRSLRLSCAASGFTFSSYG MHWVRQAPGKGLEWVAVILYDGSNKYYADSV KGRFTISRDNSKNTLYLQMNSLRAEDTAVYYCA KSLGPYCSGGNCYSSYFDYWGQGTLVTVSS | 3193 | AKSLGP YCSGGN CYSSYFD Y |
| COV107_Plate2_HC_44-P1369 | 3085 | QVQLVESGGGVVQPGRSLRLSCAASGFTFSSYG MHWVRQAPGKGLEWVAVISYDGSNKYYGDSV KGRFTISRDNSKNTLYLQMNSLRAEDTAVYYCA KKGGGAYCGGDCYLGEFDYWGQGTLVTVSS | 3194 | AKKGGG AYCGGD CYLGEF DY |
| COV107_Plate2_HC_76-P1369 | 3089 | QVQLVESGGGVVQPGRSLRLSCAASGFTFSSYG MHWVRQAPGKGLEWVAVISDDGSNKYYADSV KGRFTISRDNSKNTLYLQMNSLRAEDTAVYYCA KSWWLSENWFDPWGQGTLVTVSS | 3195 | AKSWW LSENWF DP |
| COV107_Plate1_HC_16-P1369 | 3093 | QVQLVESGGGVVQPGRSLRLSCAASGFTFSTYG MHWVRQAPGKGLEWVAVISYDGSNKYYADSV KGRFTISRDNSKNTLYLQMNSLRAEDTAVYYCA KGGLYDSSGYYPHYGMDVWGQGTTVTVSS | 3196 | AKGGLY DSSGYY PHYGM DV |
| COV107_Plate1_HC_10-P1369 | 3097 | QVQLVESGGGVVQPGRSLRLSCAASGFTFSSYA MHWVRQAPGKGLEWVAVILYDGSNKYYADSV KGRFTISRDNSKNTLYLQMNSLRAEDTAVYYCA RDQDLDTAMVTLFDYWGQGTLVTVSS | 3197 | ARDQDL DTAMV TLFDY |
| COV107_Plate1_HC_65-P1369 | 3101 | QVQLVESGGGVVQPGRSLRLSCAASGFTFSSYAI HWVRQAPGKGLEWVAVISYDGSNKYYADSVK GRFTISRDNSKNTLYLQMNSLRADDTAVYYCAR DSPSQIVVVPVFDYWGQGTLVTVSS | 3198 | ARDSPS QIVVVP VFDY |
| COV107_Plate1_HC_2-P1369 | 3105 | EVQLVESGGGLVQPGGSLRLSCAASGFTFSGYS MNWVRQAPGKGPEWVSYISRSSSTIYYADSVK GRFTISRDNAKNSLYLQMNSLRDEDTAVYYCAR EGARVGATYDTYYFDYWGQGTLVTVSS | 3199 | AREGAR VGATYD TYYFDY |
| COV107_Plate2_HC_64-P1369 | 3109 | EVQLVESGGDLVQPGGSLRLSCAASGFTFSSYS MNWVRQAPGKGLEWVSYISISSSTIYYADSVKG RFTISRDNAKNSLYLQMNSLRDEDTAVYYCARV AIRVVVPSATYYFDYWGQGTLVTVSS | 3200 | ARVAIR WVPSA TYYFDY |
| COV107_Plate2_HC_11-P1369 | 3113 | EVQLVESGGGLVQPGGSLRLSCAASGFTFSSYS MNWVRQAPGKGLEWVSYISTSSSTIYYADSVQ GRFTISRDNAKNSLYLQMNSLRDEDTAVYYCAR DQGYCSSTSCYDGYYYMDVWGKGTTVTVSS | 3201 | ARDQGY CSSTSCY DGYYYY MDV |
| COV107_Plate1_HC_44-P1369 | 3117 | EVQLVESGGGLIQPGGSLRLSCAASGFTVSSNY MSWVRQAPGKGLEWVSVIYSGGSTFYADSVKG RFTISSDNSKNTLYLQMNSLRAEDTAVYYCARDL RGPGTFDIWGQGTMVTVSS | 3202 | ARDLRG PGTFDI |
| COV107_Plate1_HC_88-P1369 | 3121 | EVQLVESGGGLIQPGGSLRLSCAASGLTVSSNY MSWVRQAPGKGLEWVSVIYSGGSTFYADSVKG RFTISRDNSKNTLYLQMNSLRAEDTAVYYCARE VAAFDIWGQGTMVTVSS | 3203 | AREVAA FDI |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_HC_18-P1369 | 3125 | EVQLVESGGGLIQPGGSLRLSCAASGVTVSRNYMSWVRQAPGKGLEWVSVIYSGGSTYYADSVKGRFTISRDNSKNTLYLQMNSLRAEDTAVYYCARDLSAAFDIWGQGTMVTVSS | 3204 | ARDLSAAFDI |
| COV107_Plate1_HC_59-P1369 | 3129 | EVQLVESGGGLIQPGGSLRLSCAASGFIVSSNYMSWVRQAPGKGLEWVSIIYSGGSTFYADSVKGRFTISRDNSKNTLYLQMNSLRAEDTAVYYCARTMDGDYFDYWGQGTLVTVSS | 3205 | ARTMDGDYFDY |
| COV107_Plate1_HC_30-P1369 | 3133 | EVQLVESGGGLIQPGGSLRLSCAASGFTVSSNYMSWVRQAPGKGLEWVSLIYSGGSTYYADSVKGRFTISRDNSKNTLYLQMNSLRAEDTAVYYCARTDIVVVPAARGFYFDYWGQGTLVTVSS | 3206 | ARTDIVWPAARGFYFDY |
| COV107_Plate1_HC_15-P1369 | 3137 | EVQLVESGGGLIQPGGSLRLSCAASGLTVSSNYMSWVRQAPGKGLEWVSVLYSGGSSFYADSVKGRFTISRDNSKNTLYLQMNSLRAEDTAVYYCARESGDTTMAFDYWGQGTLVTVSS | 3207 | ARESGDTTMAFDY |
| COV107_Plate2_HC_23-P1369 | 3141 | EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLGTGLFDYWGQGTLVTVSS | 3208 | ARDLGTGLFDY |
| COV107_Plate1_HC_82-P1369 | 3145 | EVQLVESGGGLIQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS | 3209 | ARDYGDFYFDY |
| COV107_Plate2_HC_95-P1369 | 3149 | EVQLVESGGGLIQPGGSLRLSCAASGFTVSYNYMSWVRQAPGKGLEWVSIIYSGGSTYYADSVKGRFTISRDNSKNTLYLQMNSLRAEDTAIYYCARDYGDLYFDYWGQGTLVTVSS | 3210 | ARDYGDLYFDY |
| COV107_Plate1_HC_86-P1369 | 315353 | EVQLVESGGGLIQPGGSLRLSCAASGFTVSSNYMSWVRQAPGKGLEWVSVIYSGGSTYYADSVKGRFTISRDNSKNTLYLQMNSLRADDTAVYYCATDLTSGRGPWGQGTLVTVSS | 321111 | ATDLTSGRGP |
| COV107_Plate2_HC_78-P1369 | 3157 | EVQLVESGGGLIQPGGSLRLSCAASGFTVSSNYMTWVRQAPGKGLEWVSVIYSGGTTYYADSVKGRFTISRDNSKNTLYLQMNSLRAEDTAVYYCARDLVVWGMDVWGQGTTVTVSS | 3212 | ARDLWWGMDV |
| COV107_Plate2_HC_9-P1369 | 3161 | EVQLVESGGGLVQPGGSLKLSCAASGFTFSGSAMHWVRQASGKGLEWVGRIRSKANSYATTYAASVKGRFTISRDDSKNTAYLQMNSLKTEDTAVYYCTKPHAHCGGDCYSRDWFDPWGQGTLVTVSS | 3213 | TKPHAHCGGDCYSRDWFDP |
| COV107_Plate2_HC_50-P1369 | 3165 | EVQLVESGGGLVQPGRSLRLSCAASGFTFDDYAIHWVRQAPEKGLEWVSGINWSSGSIVYADSVKGRFTISRDNAKNSLYLQMNSLRAEDTALYYCAKGLIAELVGGGWYFDYWGQGTLVTVSS | 3214 | AKGLIAELVGGGWYFDY |
| COV107_Plate1_HC_74-P1369 | 3169 | EVQLVESGGGLVQPGRSLRLSCAASGFTFDDYAMHWVRQAPGKGLEWVSGVSWNSGSIGYADSVRGRFTISRDNAKNSLYLQMNSLRAEDTALYYCAKALSSTGFLVVYFDYWGRGTLVTVSS | 3215 | AKALSSTGFLVVYFDY |
| COV107_Plate1_HC_93-P1369 | 3173 | QVQLQESGPGLVKPSQTLSLTCTVSGGSISSGGYYWSWIRQHPGKGLEWIGYIYYSGSTYYNPSLKSRVTISVDTXKNQFSLKLSSVTAADTAVYYCAWRYSSSWYTVDNKKGDYYFDYWGQGTLVTVSS | 3216 | AWRYSSSWYTVDNKKGDYYFDY |
| COV107_Plate1_HC_45-P1369 | 3177 | EVQLVQSGAEVKKPGESLRISCKGSAYIFTTYWISWVRQMPGKGLEWMGRIDPSDSYTNYSPSFQGHVTISADKSISTAYLQWSSLKASDTAMYYCARHISSGWYDYWGQGTLVTVSS | 3217 | ARHISSGWYDY |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_HC_39-P1369 | 3181 | EVQLVQSGAEVKKPGESLRISCKGSGYSFTSYYIS WVRQMPGKGLEWMGRIDPSDSYTNYSPSFQG HVTISADKSISAAYLQWSSLKASDTAMYYCARH RHPGITMIVALDYWGQGTLVTVSS | 3218 | ARHRHP GITMIV ALDY |
| COV107_Plate1_HC_37-P1369 | 3185 | EVQLVQSGAEVKKPGESLKISCKGSGYSFTSYWI GWVRQMPGKDLEWMGIIYPGDSDTRYSPSFQ GQVTISADKSISTAYLQWSSLKASDTAMYYCALT TVTTGRWFDPWGQGTLVTVSS | 3219 | ALTTVTT GRWFD P |
| KAPPA | | | | |
| COV107_Plate1_Kappa_9-P1389 | 2370 | EIVLTQSPGTLSLSPGERATLSCRASQSV TSYLAWYQQKPGQAPRLLIYGASSRAT GIPDRFSGSGSGTDFTLTISRLDPEDFAV YYCQQYGSSPRTFGQGTKVEIK | 2411 | QQY GSS PRT |
| COV107_Plate1_Kappa_36-P1389 | 2374 | EIVLTQSPGTLSLSPGERATLSCRASQSV SSSYLAWYQQKPGQAPRLLIYGAFSRA TGIPDRFSGSGSGTDFTLTISRLEPEDFA VYYCQQYGSSPRTFGQGTKVEIK | 2415 | QQY GSS PRT |
| COV107_Plate1_Kappa_40-P1389 | 2378 | EIVLTQSPGTLSLSPGERATLSCRASQSV TSYLAWYQQKPGQAPRLLIYGASSRAT GIPDRFSGSGSGTDFTLTISRLDPEDFAV YYCQQYGSSPRTFGQGTKVEIK | 2419 | QQY GSS PRT |
| COV107_Plate2_kappa_13-P1389 | 2382 | EIVLTQSPGTLSLSPGERATLSCRASQSV SSSYLAWYQQKPGQAPRLLIYGASSRA TGIPDRFSGSGSGTDFTLTISRLEPEDFA VYYCQQYGSSPRTFGQGTKVEIK | 2423 | QQY GSS PRT |
| COV107_Plate2_kappa_93-P1389 | 2386 | EIVLTQSPGTLSLSPGERATLSCRASQSV SSSYLAWYQQKPGQAPRLLIYGASSRA TGIPDRFSGGGSETDFTLTISRLEPEDCA VYYCQQYGSSPRTFGQGTKVEIK | 2427 | QQY GSS PRT |
| COV107_Plate1_Kappa_11-P1389 | 2390 | EIVLTQSPGTLSLSPGERATLSCRASQTL TANYLAWYQQKPGQAPRLLIYGASKRA AGIPDRFSGSGSGTDFTLSITRLEPEDFA VYYCQQYHTTPRTFGGGTKVEI | 2431 | QQY HTT PRT |
| COV107_Plate1_Kappa_42-P1389 | 2394 | EIVLTQSPGTLSLSPGERATLSCWASQS VSASYLAWYQQKPGQAPRLLIYGASSR ATGIPDRFSGSGSGTDFTLTISRLEPEDF AVYYCQQYGTTPRTFGGGTKVEIK | 2435 | QQY GTT PRT |
| COV107_Plate1_Kappa_84-P1389 | 2398 | EIVLTQSPGTLSLSPGERATLSCRASQTL TANYLAWYQQKPGQAPRLLIYGASKRA TGIPDRFSGSGSGTDFTLSISRLEPEDFA VYYCQQYGTTPRTFGGGTKVEI | 2439 | QQY GTT PRT |
| COV107_Plate2_kappa_31-P1389 | 2402 | EIVLTQSPGTLSLSPGERATLSCRASQTV SANYLAWYQQKAGQAPRLLIYGASKRA TGIPDRFSGSGSGTDFTLSISRLEPEDFA VYYCQQYVTTPRTFGGGTKVEI | 2443 | QQY VTT PRT |
| COV107_Plate2_kappa_53-P1389 | 2406 | EIVLTQSPGTLSLSPGERATLSCRASQTV TANYLAWYQQKPGQAPRLLIYGASKRA TGIPDRFSGSGSGTDFTLSISRLEPEDFA VYYCQQYTTTPRTFGGGTKVEI | 2447 | QQY TTT PRT |
| LAMBDA | | | | |
| COV107_Plate1_Lambda_29-P1409 | 2410 | QSALTQPPSASGSPGQSVTISCTGTSSD VGGYNYVSWYQQHPGKAPKLMIYEVS KRPSGVPDRFSGSKSGNTASLTVSGLQ AEDEADYYCSSYAGSNNFVVFGGGTKL TVL | 2451 | SSY AGS NNF VV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_Lambda_35-P1409 | 2414 | QSVLTQPPSASGSPGQSVTISCTGTSSD VGGYNYVSWYQQHPGKAPKLMIYEVR KRPSGVPDRFSGSKSGNTASLTVSGLQ AEDEADYYCSSYAGSNNFVLFGGGTKL TVL | 2455 | SSY AGS NNF VL |
| COV107_Plate2_lambda_4-P1409 | 2418 | QSVLTQPPSASGSPGQSVTISCTGTSSD VGGYKYVSWYQQHPGKAPKLMIYEVS KRPSGVPDRFSGSKSGNTASLTVSGLQ AEDEADYYCSSYEGSNNFVVFGGGTKL TVL | 2459 | SSYE GSN NFV V |
| COV107_Plate1_Lambda_63-P1409 | 2422 | QSVLTQPPSASGTPGQRVTISCSGSSSN IGSNYVYWYQQLPGTAPKLLIYRNNQR PSGVPDRFSGSKSGTSASLAISGLRSEDE ADYYCAAWDDSLSGFVVFGGGTKLTVL | 2463 | AA WD DSL SGF VV |
| COV107_Plate1_Lambda_68-P1409 | 2426 | QSVLTQPPSASGTPGQRVTISCSGSSSN IGSNYVYWYQQLPGTAPKLLIYRNNQR PSGVPDRFSGSKSGTSASLAISGLRSEDE ADYYCAAWDDSLSGFVVFGGGTKLTVL | 2467 | AA WD DSL SGF VV |
| COV107_Plate1_Lambda_13-P1409 | 2430 | QSVLTQPPSASGTPGQRVTISCSGSSSN IGSNTVNWYQQLPGTAPKLLIYSNNQR PSGVPDRFSVSKSGTSASLAISGLQSED EADYYCAAWDDSLNGVVFGGGTKLTV L | 2471 | AA WD DSL NGV V |
| COV107_Plate1_Lambda_27-P1409 | 2434 | QSVLTQPPSASGTPGQRVTISCSGSSSN IGSNTVNWYQQLPGTAPKLLIYSNNQR PSGVPDRFSGSKSGTSASLAISGLQSED EADYYCAAWDDSLNGVVFGGGTKLTV L | 2475 | AA WD DSL NGV V |
| COV107_Plate1_Lambda_79-P1409 | 2438 | QSVLTQPASVSGSPGQSITISCTGTSSD VGGYKYVSWYQRHPGKAPKLMIYDVS NRPSGVSNRFSGSKSGNTASLTISGLQA EDEADYYCSSYTSSSTSVVFGGGTQLTV L | 2479 | SSYT SSST SVV |
| COV107_Plate1_Lambda_91-P1409 | 2442 | QSALTQPASVSGSPGQSITISCTGTSSD VGGYKYVSWYQRHPGKAPKLMIYDVS NRPSGVSNRFSGSKSGNTASLTISGLQA EDEADYYCSSYTSSSTSVVFGGGTQLTV L | 2483 | SSYT SSST SVV |
| KAPPA | | | | |
| COV107_Plate1_Kappa_53-P1389 | 2446 | EIVLTQSPGTLSLSPGERATLSCRASQSV SSSYLAWYQQKPGQAPRLLIYGASSRA TGIPDRFSGSGSGTDFTLTISRLEPEDFA VYYCQQYGNSPWTFGQGTKVEIK | 2487 | QQY GNS PWT |
| COV107_Plate2_kappa_81-P1389 | 2450 | EIVLTQSPGTLSLSPGERATLSCRASQSV SSSYLAWYQQKPGQAPRLLIYGASSRA TGIPDRFSGSGSGTDFTLTISRLEPEDFA VYYCQQYGSSPWTFGQGTKVEIK | 2491 24 91 | QQY GSS PWT |
| LAMBDA | | | | |
| COV107_Plate2_lambda_42-P1409 | 2454 | QSVLTQPPSVSAAPGQKVTISCSGSSSN IGNNYVSWYQQLPGTAPKLLIYENNKR PSGIPDRFSGSKSGTSATLGITGLQTGD EADYYCGTWDSSLSAGGVYVFGTGTTV TVL | 2495 | GT WD SSLS AGG VYV |
| COV107_Plate2_lambda_89-P1409 | 2458 | QSVLTQPPSVSAAPGQKVTISCSGSSSN IGNNLVSWYQQLPGTAPKLLIYENNKR PSGIPDRFSGSKSGTSATLGITGLQTGD EADYYCGAWDSSLSAGGVYVFGTGTK VTVL | 2499 | GA WD SSLS AGG VYV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_Lambda_22-P1409 | 2462 | QSALTQPASVSGSPGQSITISCTGTSSD VGGYNYVSWYQQHPGKAPKLMIYDVS NRPSGVSNRFSGSKSGNTASLTISGLQA EDEADYYCSSYTSSSTWVFGGGTKLTVL | 2503 | SSYT SSST WV |
| COV107_Plate2_lambda_88-P1409 | 2466 | QSVLTQPASVSGSPGQSITISCTGTSSD VGGYNYVSWYQQHPGKAPKLMIYDVS NRPSGVSNRFSGSKSGNTASLTISGLQA EDEADYYCSSYTSSSTWVFGGGTKLTVL | 2507 | SSYT SSST WV |
| COV107_Plate2_lambda_49-P1409 | 2470 | QSVLTQSPSASASLGASVKLTCTLSSGH SSYAIAWHQQQPEKGPRYLMKLNTDG SHSKGDGIPDRFSGSSSGAERYLTISSLQ SEDEADYYCQTWGTGILVFGGGTKLTV L | 2511 | QT WG TGIL V |
| COV107_Plate2_lambda_84-P1409 | 2474 | QSVLTQSPSASASLGASVKLTCTLSSGH SSYAIAWHQQQPEKGPRYLMKLNSDG SHSKGDGIPDRFSGSSSGAERYLTISSLQ SEDEADYYCQTWGTGILVFGGGTKLTV L | 2515 | QT WG TGIL V |
| KAPPA | | | | |
| COV107_Plate1_Kappa_19-P1389 | 2478 | DIQMTQSPSTLSASVGDRVTITCRASQS MSSWLAWYQQKPGNAPKLLIYKASSLE SGVPSRFSGSGSGTEFTLTISSLQPDDFA TYYCQQHNSSPLTFGGGTKVEIK | 2519 | QQ HNS SPLT |
| COV107_Plate1_Kappa_38-P1389 | 2482 | DIQMTQSPSTLSASVGDRVTITCRASQS MSSWLAWYQQKPGNAPKLLIYKASSLE SGVPSRFSGSGSGTEFTLTISSLQPDDFA TYYCQQHNSSPLTFGGGTKVEIK | 2523 | QQ HNS SPLT |
| COV107_Plate2_kappa_15-P1389 | 2486 | DIVMTQSPLSLSVTPGEPASISCRSSQSL LHSNGNNYFDWYLQKPGQSPQLLIYLG SNRASGVPDRFSGSGSGTDFTLKISRVE AEDVGVYYCMQVLQIPYTFGQGTKLEI | 2527 | MQ VLQI PYT |
| COV107_Plate2_kappa_69-P1389 | 2490 | DIVMTQSPLSLPVTPGEPASISCRSSQSL LQSNGNNYFDWYLQKPGQSPQLLIYLG SNRASGVPDRFSGSGSGTDFTLKISRVE AEDVGVYYCMQVLQVPYTFGQGTNLE I | 2531 | MQ VLQ VPY T |
| COV107_Plate2_kappa_32-P1389 | 2494 | DIQMTQSPSSLSASVGDTVTITCQASQ DISKYLNWYQQKPGKAPKLLIYDASNLE TGVPSRFSGSGSGTDFTFTISSLQPEDIA TYYCQQYDNLPQTFGGGTKVEIK | 2535 | QQY DNL PQT |
| COV107_Plate2_kappa_73-P1389 | 2498 | DIQMTQSPSSLSASVGDTVTITCQASQ DISKYLNWYQQKPGKAPKLLIYDASNLE TGVPSRFSGSGSGTDFTFTISSLQPEDIA TYYCQQYDNLPQTFGGGTKVEIK | 2539 | QQY DNL PQT |
| LAMBDA | | | | |
| COV107_Plate1_Lambda_62-P1409 | 2502 | QSVLTQPPSVSGAPGQRVTISCTGTSS NIGAGYDVHWYQQLPGRAPKVLISGN NIRPSEVPDRFSGSRSGTSASLAITSLQP EDEAQYYCQSYDSSLYAVFGGGTKLTVL | 2543 | QSY DSS LYA V |
| COV107_Plate1_Lambda_73-P1409 | 2506 | QSVLTQPPSVSGAPGQRVTISCTGTSS NIGAGYDVHWYQQLPGRAPKVLISGN NIRPSEVPDRFSGSRSGTSASLAITSLQP EDEAQYYCQSYDSSLYAVFGGGTKLTVL | 2547 | QSY DSS LYA V |
| COV107_Plate1_Lambda_46-P1409 | 2510 | QSALTQPASVSGSPGQSITISCTGTSSD VGGYNFVSWYQQHPGKAPKLMIYDVS NRPSGVSNRFSGSKSGNTASLTISGLQA EDEADYYCNSYTSSSTRVFGTGTKVTVL | 2551 | NSY TSSS TRV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_lambda57-P1409 | 2514 | QSVLTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL | 2555 | NSYTSSSTRV |
| COV107_Plate2_lambda_36-P1409 | 2518 | QSVLTQPPSVSEAPRQRVTISCSGSSSNIGNNAVNWYQQLPGKAPKLLIYYDDLLPSGVSDRFSGSKSGTSASLAISGLQSEDEADYYFAAWDDSLNGAWVFGGGTKLTVL | 2559 | AAWDDSLNGAWV |
| COV107_Plate2_lambda71-P1409 | 2522 | QSVLTQPPSVSEAPRQRVTISCSGSSSNIGNNAVNWYQQVPGKAPKLLIYYDDLLPSGVSDRFSGSKSGTSASLAISGLQSEDEADYYCAAWDDSLNGAWVFGGGTKLTVL | 2563 | AAWDDSLNGAWV |
| COV107_Plate1_Lambda_77-P1409 | 2526 | SYVLTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL | 2567 | QVWDSSRDHVV |
| COV107_Plate2_lambda_72-P1409 | 2530 | SYVLTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL | 2571 | QVWDSSRDHVV |

KAPPA

| COV107_Plate1_Kappa_75-P1389 | 2534 | DIQMTQSPSTLSASVGDRATITCRASQSISYWLAWYQQKPGKAPKLLIYKASSLESGVPSRFSGSGSGTEFTLTISSLQPDDSATYYCQQYNSYPYTFGQGTKLEIK | 2575 | QQYNSYPYT |
| COV107_Plate2_kappa_90-P1389 | 2538 | DIQMTQSPSTLSASVGDRVTITCRASQSISYWLAWYQQKPGKAPKLLIYQASSLESGVPSRFSGSESGTEFTLTISSLQPDDFATYYCQQYNSYPYTFGQGTKLEIK | 2579 | QQYNSYPYT |

LAMBDA

| COV107_Plate1_Lambda_52-P1409 | 2542 | QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL | 2583 | AAWDDSLNGHVV |
| COV107_Plate1_Lambda_58-P1409 | 2546 | NFMLTQPHSVSESPGKTVTISCTGSSGSIASNYVQWYQQRPGSAPTTMIYEDNQRPSGVPDRFSGSIDSSSNSASLTISGLKTEDEADYYCQSYDSSTPNCVFGGGTKLTVL | 2587 | QSYDSSTPNCV |
| COV107_Plate2_lambda_45-P1409 | 2550 | QSVLTQPASVSGSPGQSITISCTGTSSDVGGYNYVSWYQQHPGKAPKVMIYDVSNRPSGVSNRFSGSKSGNTASLTISGLQAEDEADYYCSSYTSSSTLLFGGGTKLTXL | 2591 | SSYTSSSTLL |
| COV107_Plate1_Lambda_60-P1409 | 2554 | QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL | 2595 | CSYAGSSTWV |
| COV107_Plate1_Lambda_5-P1409 | 2558 | SYVLTQPPSVSVAPGKTARITCGGNNIGSKNVHWYQQKPGQAPVLVIYYDSDRPSGIPERFSGSNSGNTATLTISRVEAGDEADYYCQVWDSSWVFGGGTKLTVL | 2599 | QVWDSSWV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_lambda_94-P1409 | 2562 | QSVLTQPASVSGSPGQSITISCTGTSSD VGSYNLVSWYQQHPGKAPKLMIYEGS KRPSGVSNRFSGSKSGNTASLTISGLQA EDEADYYCCSYAGSSTLVFGGGTKLTVL | 2603 | CSY AGS STLV |
| COV107_Plate1_Lambda_83-P1409 | 2566 | SYVLTQPPSVSVSPGQTASITCSGDKLG DKYACWYQQKAGQSPVLVIYQDSKRP SGIPERFSGSKSGNTATLTISGTQAMDE ADYYCQAWDSSTVVFGGGTKLTVL | 2607 | QA WD SST VV |
| COV107_Plate2_lambda_40-P1409 | 2570 | QSVLTQPPSVSGAPGQRVTISCTGSSSN IGAGYDVHWYQHLPGTAPKLLIYGNN NRPSGVPDRFSGSRSGTSASLAITGLQA EDEADYYCQSYDSSLSAVVFGGGTKLT VL | 2511 | QSY DSS LSA VV |
| COV107_Plate1_Lambda_28-P1409 | 2574 | QSVLTQPPSVSGAPGQRVTISCTGSSSN IGAGYDVHWYQQLPGTAPNLLIYDNIN RPSGVPDRFSGSKSGTSASLAITGLQAE DEADYYCQSYDSSLSGVVFGGGTKLTV L | 2615 | QSY DSS LSG VV |
| COV107_Plate2_lambda_92-P1409 | 2578 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDSSKHAVFGGGTQLTV L | 2619 | QSY DSS KHA V |
| COV107_Plate2_lambda_55-P1409 | 2582 | NFMLTQPHSVSESPGKTVTISCAGSSGS IASNYVQWYQQRPGSAPTTVIYEDNQ RPSGVPDRFSGSIDSSSNSASLTISGLKT EDEADYYCQSYDSSKSWVFGGGTKLTV L | 2623 | QSY DSS KSW V |
| COV107_Plate2_lambda_47-P1409 | 2586 | QSVLTQPPSVSGAPGQRVTISCTGSSSN IGAGYDVHWYQQLPGTAPKLLIYGNSN RPSGVPDRFSGSKSGTSASLAITGLQAE DEADYYCQSYDSSLSGSYVFGTGTKVTV L | 2627 | QSY DSS LSG SYV |
| COV107_Plate1_Lambda_49-P1409 | 2590 | SYVLTQPPSVSVAPGKTARITCGGNNIG SKSVHWYQQKPGQAPVLVISYDSDRPS GIPERFSGSNSGNTATLTISRVEAGDAA DYYCQVWDGSSDHHVVFGGGTKLTVL | 2631 | QV WD GSS DHH VV |
| COV107_Plate2_lambda_22-P1409 | 2594 | QSVLTQPPSVSAAPGQRVTISCSGSSSN IGNNYVSWYQQLPGTAPKLLIYENNKR PSGIPDRFSGSKSGTSATLGITGLQTGD EADYYCGTWDSSLSAFVFGTGTKVTVL | 2635 | GT WD SSLS AFV |
| COV107_Plate2_lambda_91-P1409 | 2598 | QSALTQPASVSGSPGQSITISCTGTSSD VGGYNYVSWYQQHPGKAPKLMIYDVS NRPSGVSNRFSGSKSGNTASLTISGLQA EDEADYYCSSYTSSSTLGVFGTGTKVTV L | 2639 | SSYT SSST LGV |
| COV107_Plate2_lambda_35-P1409 | 2602 | SYVLTQPPSVSVAPGKTARITCGGNNIG SKSVHWYQQKPGQAPVLVIYYDSDRPS GIPERFSGSNSGNTATLTISRVEAGDAA DYYCQVWDSSSDHPVVFGGGTKLTVL | 2643 | QV WD SSS DHP VV |
| COV107_Plate2_lambda_24-P1409 | 2606 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDSSNQWVFGGGTKL TVL | 2647 | QSY DSS NQ WV V |
| COV107_Plate2_lambda_34-P1409 | 2610 | QSVLTQPASVSGSPGQSITISCPGTSSD VGGYNYVSWYQQHPGKAPKLMIYDVS TRPSGVSNRFSGSKSGNTASLTISGLQA EDEADYYCSSYTSSSVVFGGGTKLTVL | 2651 | SSYT SSS VV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_Lambda_41-P1409 | 2614 | SYVLTQPPSVSVAPGKTARITCGGNNIG SKSVHWYQQKPGQAPVLVIYYDSDRPS GIPERFSGSNSGNTATLTISRVEAGDEA DYYCQVWDSSRVFGGGTKLTVL | 2655 | QVWDSSRV |
| COV107_Plate2_lambda_46-P1409 | 2618 | QSVLTQPPSASGSPGQSVTISCTGTSSD VGGYNYVSWYQQHPGKAPKLMIYEVT KRPSGVPDRFSGSKSGNTASLTVSGLQ AEDEADYYCSSYAGSNNYVVFGGGTKL TVL | 2659 | SSYAGSNNYVV |
| COV107_Plate1_Lambda_32-P1409 | 2622 | NFMLTQPHSVSESPGKTVTISCTGSSGS IASNYVQWYQQRPGSAPTTVIYEDNQ RPSGVPDRFSGSIDSSSNSASLAISGLKT EDEADYYCQSYDSSNHVVFGGGTKLTV L | 2663 | QSYDSSNHVV |
| COV107_Plate2_lambda_25-P1409 | 2626 | SYVLTQPPSVSVAPGKTARITCGGNNIG SKSVHWYQQKPGQAPVLVIYYDSVRPS GIPERFSGSNSGNTATLTISRVEAGDEA DYYCQVWDSSSDHYVFGTGTKVTVL | 2667 | QVWDSSSDHYV |
| COV107_Plate2_lambda_54-P1409 | 2630 | QSVLTQPPSVSGAPGQRVTISCTGSSSN IGAGYDVHWYQQLPGTAPKLLIYGNSD RPSGVPDRFSGSKSGTSASLAITGLQAE DEADYYCQSYDSSLSGVVFGGGTKLTXL | 2671 | QSYDSSLSGVV |
| COV107_Plate2_lambda_20-P1409 | 2634 | QSVLTQPASVSGSPGQSITISCTGTSSD VGSYNLVSWYQQHPGKAPKLMIYEGS KRPSGVSNRFSGSKSGNTASLTISGLQA EDEADYYCCSYAGSSTWVFGGGTKLTV L | 2675 | CSYAGSSTWV |
| COV107_Plate1_Lambda_25-P1409 | 2638 | QSALTQPASVSGSPGQSITISCTGTSSD VGGYNYVSWYQQHPGKAPKLMIYDVS NRPSGVSNRFSGSKSGNTASLTISGLOA EDEADYYCSSYTSSSTYVFGTGTKVTVL | 2679 | SSYTSSSTYV |
| COV107_Plate1_Lambda_64-P1409 | 2642 | QSVLTQPASVSGSPGQSITISCTGTSSD VGGYNYVSWYQQHPGEAPKLMIHDV SNRPSGVSNRFSGSKSGNTASLTISGLQ AEDEADYYCSSYTSSSTLVFGGGTKTV L | 2683 | SSYTSSSTLV |
| COV107_Plate2_lambda_28-P1409 | 2646 | NFMLTQPHSVSESPGKTVTISCTGSSGS IASNYVQWYQQRPGSAPTTVINEDNQ RPSGVPDRFSGSIDSSSNSASLTISGLKT EDEADYYCQSYDSSNLVFGGGTKLTVL | 2687 | QSYDSSNLV |
| COV107_Plate2_lambda_58-P1409 | 2650 | QSVLTQPASVSGSPGQSITISCTGTSSD VGSYNLVSWYQEHPGKAPKLMIYEGSK RPSGVSNRFSGSKSGNTASLTISGLOAE DEADYYCCSYAGSSTWVFGGGTKLTVL | 2691 | CSYAGSSTWV |
| COV107_Plate2_lambda_2-P1409 | 2654 | NFMLTQPHSVSESPGKTVTISCTGSSGS IASNYVQWYQQRPGSAPTTVIYEDNQ RPSGVPDRFSGSIDSSSNSASLTISGLKT EDEADYYCQSYDTSNWVFGGGTKLTV L | 2695 | QSYDTSNWV |
| COV107_Plate2_lambda_10-P1409 | 2658 | SYVLTQPPSVSVAPGKTARITCGGNNIG SKSVHWYQQKPGQAPVLVIYYDTDRPS GIPERFSGSNSGNTATLTISRVEAGDEA DYYCQVWDNNSDHRGVFGGGTRLTV L | 2699 | QVWDNNSDHRGV |
| COV107_Plate1_Lambda_48-P1409 | 2662 | QSALTQPASVSGSPGQSITISCTGTSSD VGGYNYVSWYQQHPGKAPKLMIYDVS NRPSGVSNRFSGSKSGNTASLTISGLOA EDEADYYCSSYTSSSTVWVFGGGTKLT VL | 2703 | SSYTSSSTVWV |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_lambda_87P1409- | 2666 | QSVLTQPPSASGTPGQRVTIACSGSSSNIGSSPVKWYKQLPGTGPKLLIYSSNQRPSGVPDRFSGSKSGTSASLAISGLQSEDEADYYCAAWDDSLSGYVFGTGTKVTVL | 2707 | AAWDDSLSGYV |
| COV107_Plate2_lambda_1-P1409 | 2670 | QSVLTQPPSASGTPGQRVTISCSGSSSNIGSNTVNWYQQLPGTAPQLLIYNNYQRPSGVPDRFSGSKSGTSASLAISGLQSEDEADYYCAAWDDSLNGPVVFGGGTKLTVL | 2711 | AAWDDSLNGPVV |
| COV107_Plate1_Lambda_92-P1409 | 2674 | QSALTQPASVSGSPGQSITISCTGTSSDVGSYNLVSWYQQHPGKAPKLMIYEGSKRPSGVSNRFSGSKSGNTASLTISGLQAEDEADYYCCLYAFSSIVFGGGTKLTVL | 2715 | CLYAFSSIV |
| COV107_Plate1_Lambda_26-P1409 | 2678 | QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLNGLVFGGGTKLTVL | 2719 | AAWDDSLNGLV |

KAPPA

| SEQUENCE_ID | SEQ ID NO | aa | SEQ ID NO | cdr3_aa |
|---|---|---|---|---|
| COV107_Plate2_kappa_18-P1389 | 2682 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGQGTRLEIK | 2723 | QQYGSSLT |
| COV107_Plate1_Kappa_21-P1389 | 2686 | DIQMTQSPSSLSASVGDRVTITCRASQSISSYLNWYQQKPGKAPKLLIYSASSLQSGVPSRFSGSGSGTDFTLTISSLQPEDFATYYCQQSYSTLITFGQGTRLEIK | 2727 | QQSYSTLIT |
| COV107_Plate1_Kappa_24-P1389 | 2690 | EIVMTQSPATLSVSPGERATLSCRASQSVSSNLAWYQQKPGQAPTLLIYGASTRATGIPARFSGSGSGTEFTLTISSLQSEDFAVYYCQQYNNWPPITFGQGTRLEIK | 2731 | QQYNNWPPIT |
| COV107_Plate2_kappa_17-P1389 | 2694 | EIVLTQSPGTLSLSPGERATLSCRASQSVSSSYLAWYQQKPGQAPRLLIYGASSRATGIPDRFSGSGSGTDFTLTISRLEREDFAVYYCQQYGRSPTWTFGQGTKVEIK | 2735 | QQYGRSPTWT |
| COV107_Plate1_Kappa_78-P1389 | 2698 | DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK | 2739 | QQYYSTPLT |
| COV107_Plate1_Kappa_95-P1389 | 2702 | DIQLTQSPSFLSASVGDRVTITCRASQGISSYLAWFQQKPGKAPKLLIYAASTLQTGVPSRFSGSGSGTEFTLTISSLQPEDFATYYCQQLNSYPITFGQGTRLEIK | 2743 | QQLNSYPIT |
| COV107_Plate2_kappa_38-P1389 | 2706 | DIQMTQSPSSLSASVGDRVTITCRASQSISRYLNWYQQKPGKAPKLLIYAASSLQSGVPSRFSGSGSGTDFTLTISGLQPEDFATYYCQQSYSTPQYTFGQGTKLEIK | 2747 | QQSYSTPQYT |
| COV107_Plate2_kappa_61-P1389 | 2710 | DIQMTQSPSSLSASVGDRVTITCRASQSISSYLNWYQQKPGKAPKLLIYAASSLQSGVPSRFSGSGSGTDFTLTISSLQPEDFATYYCQQSYITPGWTFGQGTKVEIK | 2751 | QQSYITPGWT |
| COV107_Plate1_Kappa_80-P1389 | 2714 | EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPWTFGQGTKVEIK | 2755 | QQYGSSPPWT |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate2_kappa_68-P1389 | 2718 | DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK | 2759 | QQYDNLPPYT |
| COV107_Plate2_kappa_51-P1389 | 2722 | DIQMTQSPSSLSASVGDRVTITCQASQDISNYLNWYQQKPGKAPKLLIYDASNLETGVPSRFSGSGSGTDFTFTISSLQPEDIATYYCQQYDNVPLTFGPGTKVDIK | 2763 | QQYDNVPLT |
| COV107_Plate1_Kappa_43-P1389 | 2726 | DIQMTQSPSTLSASVGDRVTITCRASQSISSWLAWYQQKPGKAPKLLISEASSLESGVPSRFSGSGSGTEFTLTISSLQPDDFATYYCQQYNSYSYTFGQGTKLEIK | 2767 | QQYNSYSYT |
| COV107_Plate2_kappa_3-P1389 | 2730 | DIQMTQSPSTLSASVGDRVTITCRASQSISSWLAWYQQKPGKAPKLLIYEASSLESGVPSRFSGSGSGTEFTLTISSLQPDDFATYYCQQYNSYSTFGPGTKVDIK | 2771 | QQYNSYST |
| COV107_Plate2_kappa_44-P1389 | 2734 | EIVLTQSPGTLSLSPGERATLSCRASQSVSSSYLAWYQQKPGQAPRLLIYGASSRATGIPDRFSGSGSGTDFTLTISRLEPEDFAVFYCQQYGTSPSTFGQGTKVESK | 2775 | QQYGTSPST |
| COV107_Plate2_kappa_76-P1389 | 2738 | EIVMTQSPATLSVSPGERATLSCRASQSVSSNLAWYQQKPGQAPRLLIYGASTRATGIPARFSGTGSGTEFTLTISSLQSEDFAVYYCQQYNNWPLTFGGGTKVEIK | 2779 | QQYNNWPLT |
| COV107_Plate1_Kappa_16-P1389 | 2742 | DIQMTQSPSSLSASVGDRVTITCQASQDINNYLNWYQQKPGKAPKVLIYDASNLETGVPSRFSGSGSGTDFTFTISSLQPEDFATYYCQQYDNLPLAFGGGTKVEIK | 2783 | QQYDNLPLA |
| COV107_Plate1_Kappa_10-P1389 | 2746 | DIQMTQSPSSLSASVRDRVTITCRASQSISSYLNWYQQKPGKAPKLLIYAASSLQSGVPSRFSGSGSGTDFTLTISSLQPEDLATYYCQQSYSTPPWTFGQGTKVEIK | 2787 | QQSYSTPPWT |
| COV107_Plate1_Kappa_65-P1389 | 2750 | DIQMTQSPSSLSASVGDRVTITCRASQSISRYLNWYQQKPGKAPNLLIYAASSLQSGVPSRFSGSGSGTDFTLIISSLQPEDFATYYCQQSYSTLALTFGGGTKVEIK | 2791 | QQSYSTLALT |
| COV107_Plate1_Kappa_2-P1389 | 2754 | EIVLTQSPATLSLSPGERATLSCRASQSFSSLAWYQQKPGQAPRLLIYDASNRATGIPARFSGSGSGTDFTLTISSLEPEDFAVYYCQQRNNWPPEWTFGQGTKVEIK | 2795 | QQRNNWPPEWT |
| COV107_Plate2_kappa_64-P1389 | 2758 | EIVLTQSPATLSLSPGERATLSCRASQSFSSLAWYQQKPGQAPRLLIYDASNRATGIPARFSGSGSGTDFTLTISSLEPEDFAFYYCQQRSNWPQGFTFGPGTKVDIK | 2799 | QQRSNWPQGFT |
| COV107_Plate2_kappa_11-P1389 | 2762 | DIQMTQSPSSLSASVGDRVTITCRASQSISSYLNWYQQKPGKAPKLLIYAASSLHSGVPSRFSGSGSGTDFTLTISSLQPEDFATYYCQQSYSAPWTFGQGTKVEIK | 2803 | QQSYSAPWT |
| COV107_Plate1_Kappa_44-P1389 | 2766 | DIQMTQSPSSLSASVGDRVTITCQASQDISNYLNWYQQKPGKAPKLLIYDASNLETGVPSRFSGSGSGTDFTFTISSLQPEDIATYYCQQYDNLPRVTFGPGTKVDIK | 2807 | QQYDNLPRVT |
| COV107_Plate1_Kappa_88-P1389 | 2770 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPGFGQGTKVEIK | 2811 | QQLNSYPPG |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_Kappa_18-P1389 | 2774 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK | 2815 | QQLNSYPPA |
| COV107_Plate1_Kappa_59-P1389 | 2778 | DIQMTQSPSSLSASVGDRVTITCRASQDINNYLAWYQQKPGKVPKLLIYAASTLQSGVPSRFSGSGSGTDFTLTISSLQPEDVATFYCQKYNSAPLTFGGGTKVEIK | 2819 | QKYNSAPLT |
| COV107_Plate1_Kappa_30-P1389 | 2782 | DIQMTQSPSTLSASVGDRVTITCRASQSISSWLAWYQQKPGKAPKLLIYKASSLESGVPSRFSGSGSGTEFTLTISSLQPDDFATYYCQQYNSYGTFGQGTKVEIK | 2823 | QQYNSYGT |
| COV107_Plate1_Kappa_15-P1389 | 2786 | DIQLTQSPSFLSASVGDRVTITCRASQGISSYLAWYQQKPGKAPKLLIYAASTLQSGVPSRFSGSGSGTEFTLTISSLQPEDFATYYCQQLNSDSYTFGQGTKLEIK | 2827 | QQLNSDSYT |
| COV107_Plate2_kappa_23-P1389 | 2790 | DIQLTQSPSFLSASVGDRVTITCRASQGISSYLAWYQQKPGKAPKLLIYAASTLQSGVPSRFSGSGSGTEFTLTISSLQPEDFATYYCQQLDSYPPGTFGPGTKVDIK | 2831 | QQLDSYPPGT |
| COV107_Plate1_Kappa_82-P1389 | 2794 | EIVMTQSPATLSVSPGERATLSCRASQSVSSNLAWYQQKPGQAPRLLIYGASTRATGIPARFSGSGSGTEFTLTISSLQSEDFAVYYCQQYYNWPRTFGQGTKVEIK | 2835 | QQYYNWPRT |
| COV107_Plate2_kappa_95-P1389 | 2798 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTRLEIK | 2839 | QQYGSSPRT |
| COV107_Plate1_Kappa_86-P1389 | 2802 | AIQMTQSPSSLSASVGDRVTITCRASQGIRNDLGWYQQKPGKAPKLLIYAASSLQSGVPSRFSGSGSGTDFTLTISSLQPEDFATYYCLQDYNYPKTFGQGTKVEIK | 2843 | LQDYNYPKT |
| COV107_Plate2_kappa_78-P1389 | 2806 | DIQLTQSPSFLSASVGDRVTITCRASQGISSYLAWYQQKPGKAPKLLIYAASTLQSGVPSRFSGSGSGTEFTLTISSLQPEDFATYYCQLLNSYPYTFGQGTKLEIK | 2847 | QLLNSYPYT |
| COV107_Plate2_kappa_9-P1389 | 2810 | DIQMTQSPSSLSASVGDRVTITCRASQSISSYLYWYQQKPGKAPKLLIYAASSLQSGVPSRFSGSGSGTDFTLTISSLQPEDFATYYCQQSYSTPPFTFGPGTKVDIK | 2851 | QQSYSTPPFT |
| COV107_Plate2_kappa_50-P1389 | 2814 | EIVLTQSPATLSLSPGERATLSCRASQSVSSYLAWYQQKPGQAPRLLIYDASNRATGIPARFSGGGSGTDFTLTISSLEPEDFAVYYCQQRSNWPPLTFGQGTKVEIK | 2855 | QQRSNWPPLT |
| COV107_Plate1_Kappa_74-P1389 | 2818 | EIVMTQSPATLSVSPGERATLSCRASQSVSSNLAWYQQKPGQAPRLLIYGASTRATGIPARFSGSGSGTEFTLTISSLQSEDFAVYYCQQYNNWLSLTFGGGTKVEIK | 2859 | QQYNNWLSLT |
| COV107_Plate1_Kappa_93-P1389 | 2822 | DIVMTQSPLSLPVTPGEPASISCRSSESLLHSNGYNYLDWYLQKPGQSPQLLIYLGSNRASGVPDRFSGSGSGTDFTLKISRVEAEDVGVYYCMQALQTPRTFGQGTKLEIK | 2863 | MQALQTPRT |
| COV107_Plate1_Kappa_45-P1389 | 2826 | DIQMTQSPSSLSASVGDRVTITCQASQDISNYLNWYQQKPGKAPKLLIYDASNLETGVPSRFSGSKSGTDFTFTISSLQPEDIATYYCQQYDNLPYTFGQGTKVEI | 2867 | QQYDNLPYT |

TABLE 13-continued

Anti-SARS-CoV-2 IgG antibodies from COV107

| SEQUENCE_ID | SEQ ID NO | aa | SEQ ID NO | cdr3_aa |
|---|---|---|---|---|
| COV107_Plate1_Kappa_39-P1389 | 2830 | DIQMTQSPSSLSASVGDRVTITCQASQ DISNYLNWYQQKPGKAPKLLIYDASYLE TGVPSRFTGSASGTDFTFTISSLQPEDIA TYYCQQYDNVPLFGPGTKVDI | 2871 | QQY DNV PL |
| COV107_Plate1_Kappa_37-P1389 | 2834 | DVVMTQSPLSLPVTLGQPASISCRSSQS LVYSDGNTYLNWFQQRPGQSPRRLIYQ VSNRDSGVPDRFSGSGSGTDFTLKISRV EAEDVGVYYCMQGTHWLWTFGQGTK VEIK | 2875 | MQ GTH WL WT |

TABLE 14

Additional representative sequences of the example antibodies as disclosed

| SEQ ID NO | Antibody | Sequence | Notes |
|---|---|---|---|
| 2876 | C135 | QVQLVESGGGVVQPGRSLRLSCAASGFTFSSYAMHWVRQAPGKGLEWVAVIPFDGRNKYYADSVTGRFTISRDNS KNTLYLQMNSLRAEDTAVYYCASSSGYLFHSDYWGQGTLVTVSS | VH |
| 2877 | | QVQLVESGGG VVQPGRSLRL SCAASGFTFS | HFW1 |
| 2878 | | SYAMH | HCDR1 |
| 2879 | | WVRQAPGKGL EWVA | HFW2 |
| 2880 | | VIPFDGRNKY YADSVTG | HCDR2 |
| 2881 | | RFTISRDNSK NTLYLQMNSL RAEDTAVYYC AS | HFW3 |
| 2882 | | SSGYLFHSDY | HCDR3 |
| 2883 | | WGQGTLVTVS S | HFW4 |
| 2884 | | TVSS | VH end |
| 2885 | | ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKRVEP KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV LHEALHSHYT QKSLSLSPG | IGHC |
| 2886 | | QVQLVESGGGVVQPGRSLRLSCAASGFTFSSYAMHWVRQAPGKGLEWVAVIPFDGRNKYYADSVTGRFTISRDNS KNTLYLQMNSLRAEDTAVYYCASSSGYLFHSDYWGQGTLVTVSSASTKGPSVFPLAPSSKSTSGGTAALGCLVKDYFP EPVTVSWNSGALTSGVHTFPAVLQSSGLYSLSSVVTVPSSSLGTQTYICNVNHKPSNTKVDKRVEPKSCDKTHTCPPC PAPELLGGPSVFLFPPKPKDTLMISRTPEVTCVVVDVSHEDPEVKFNWYVDGVEVHNAKTKPREEQYNSTYRVVSVL TVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVLHEALHSHYTQKSLSLSPG | HC (containing M428L and N434S (LS; highlighted in bold) according to EU numbering) |
| 2887 | | MRAWIFFLLCLAGRALAQVQLVESGGGVVQPGRSLRLSCAASGFTFSSYAMHWVRQAPGKGLEWVAVIPFDGRN KYYADSVTGRFTISRDNSKNTLYLQMNSLRAEDTAVYYCASSSGYLFHSDYWGQGTLVTVSSASTKGPSVFPLAPSSK STSGGTAALGCLVKDYFPEPVTVSWNSGALTSGVHTFPAVLQSSGLYSLSSVVTVPSSSLGTQTYICNVNHKPSNTKV DKRVEPKSCDKTHTCPPCPAPELLGGPSVFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRWQQGNVFSCSVLHEALHSHYTQKSLSL SPG | HC (with N-terminal Signal sequence) (containing M428L and N434S (LS; highlighted in bold) according to EU numbering) |

TABLE 14-continued

Additional representative sequences of the example antibodies as disclosed

| SEQ ID NO | Antibody | Sequence | Notes |
|---|---|---|---|
| 2888 | | DIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIK | VL |
| 2889 | | DIQMTQSPST LSASVGDRVT ITC | LFW1 |
| 2890 | | RASQSISNWL A | LCDR1 |
| 2891 | | WFQQKPGKAP KLLIY | LFW2 |
| 2892 | | EASSLES | LCDR2 |
| 2893 | | GVPSRFSGSG SGTEFTLTIS SLQPDDFATY YC | LFW3 |
| 2894 | | QQYNSYPWT | LCDR3 |
| 2895 | | FGQGTKVEIK | LFW4 |
| 2896 | | KVEIK | VL end |
| 2897 | | RTVAAPSVFI FPPSDEQLKS GTASVVCLLN NFYPREAKVQ WKVDNALQSG NSQESVTEQD SKDSTYSLSS TLTLSKADYE KHKVYACEVT HQGLSSPVTK SFNRGEC | IGLC |
| 2898 | | DIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | LC |
| 2899 | | MRAWIFFLLCLAGRALADIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | LC (with N-terminal Signal sequence) |
| 2900 | C144' | EVQLVESGGGLIQPGGSLRLSCAASGFTVSNNYIVISWVRQAPGKGLEWVSVIYSGGSTYYADSVKGRFTISRDKSKNTLYLQMNSLRAEDTAVYYCAREGEVEGYNDFWSGYSRDRYYFDYWGQGTLVTVSS | VH |
| 2901 | | EVQLVESGGG LIQPGGSLRL SCAASGFTVS | HFW1 |
| 2902 | | NNYMS | HCDR1 |
| 2903 | | WVRQAPGKGL EWVS | HFW2 |
| 2904 | | VIYSGGSTYY ADSVKG | HCDR2 |
| 2905 | | RFTISRDKSK NTLYLQMNSL RAEDTAVYYC AR | HFW3 |
| 2906 | | EGEVEGYNDF WSGYSRDRYY FDY | HCDR3 |
| 2907 | | WGQGTLVTVS S | HFW4 |
| 2908 | | TVSS | VH end |
| 2909 | | ASTKGPSVFP LAPSSKSTSG GTAALGCLVK DYFPEPVTVS WNSGALTSGV HTFPAVLQSS GLYSLSSVVT VPSSSLGTQT YICNVNHKPS NTKVDKRVEP KSCDKTHTCP PCPAPELLGG PSVFLFPPKP KDTLMISRTP EVTCVVVDVS HEDPEVKFNW YVDGVEVHNA KTKPREEQYN STYRVVSVLT VLHQDWLNGK EYKCKVSNKA LPAPIEKTIS KAKGQPREPQ VYTLPPSREE MTKNQVSLTC LVKGFYPSDI AVEWESNGQP ENNYKTTPPV LDSDGSFFLY SKLTVDKSRW QQGNVFSCSV LHEALHSHYT QKSLSLSPG | IGHC |
| 2910 | | EVQLVESGGGLIQPGGSLRLSCAASGFTVSNNYIVISWVRQAPGKGLEWVSVIYSGGSTYYADSVKGRFTISRDKSKNTLYLQMNSLRAEDTAVYYCAREGEVEGYNDFWSGYSRDRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG | HC (containing M428L and N434S (LS; highlighted in bold) according to EU numbering) |

TABLE 14-continued

Additional representative sequences of the example antibodies as disclosed

| SEQ ID NO | Antibody | Sequence | Notes |
|---|---|---|---|
| 2911 | | MRAWIFFLLCLAGRALAEVQLVESGGGLIQPGGSLRLSCAASGFTVSNNYIVISWVRQAPGKGLEWVSVIYSGGSTYY ADSVKGRFTISRDKSKNTLYLQMNSLRAEDTAVYYCAREGEVEGYNDFWSGYSRDRYYFDYWGQGTLVTVSSASTK GPSVFPLAPSSKSTSGGTAALGCLVKDYFPEPVTVSWNSGALTSGVHTFPAVLQSSGLYSLSSVVTVPSSSLGTQTYIC NVNHKPSNTKVDKRVEPKSCDKTHTCPPCPAPELLGGPSVFLFPPKPKDTLMISRTPEVTCVVVDVSHEDPEVKFNW YVDGVEVHNAKTKPREEQYNSTYRVVSVLTVLHQ.DWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVLHE ALHSHYTQKSLSLSPG | HC (with N-terminal Signal sequence) (containing M428L and N434S (LS; highlighted in bold) according to EU numbering) |
| 2912 | | QSALTQPASVSGSPGQSITISCTGTSSDVGGYNYVSWYQQHPGKAPKLMIYDVSNRPSGVSNRFSGSKSGNTASLTIS GLQAEDEADYYCSSYTSSSTRVFGTGTKVTVL | VL |
| 2913 | | QSALTQPASV SGSPGQSITI SC | LFW1 |
| 2914 | | TGTSSDVGGY NYVS | LCDR1 |
| 2915 | | WYQQHPGKAP KLMIY | LFW2 |
| 2916 | | DVSNRPS | LCDR2 |
| 2917 | | GVSNRFSGSK SGNTASLTIS GLQ.AEDEADY YC | LFW3 |
| 2918 | | SSYTSSSTRV | LCDR3 |
| 2919 | | FGTGTKVTVL | LFW4 |
| 2920 | | GQPKAAPSVT LFPPSSEELQ ANKATLVCLI SDFYPGAVTV AWKADSSPVK AGVETTTPSK QSNNKYAASS YLSLTPEQWK SHRSYSCQVT HEGSTVEKTV APTECS | IGLC |
| 2921 | | QSALTQPASVSGSPGQSITISCTGTSSDVGGYNYVSWYQQHPGKAPKLMIYDVSNRPSGVSNRFSGSKSGNTASLTIS GLQAEDEADYYCSSYTSSSTRVFGTGTKVTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTECS | LC |
| 2922 | | MRAWIFFLLCLAGRALAQSALTQPASVSGSPGQSITISCTGTSSDVGGYNYVSWYQQHPGKAPKLMIYDVSNRPSGV SNRFSGSKSGNTASLTISGLQAEDEADYYCSSYTSSSTRVFGTGTKVTVLGQPKAAPSVTLFPPSSEELQANKATLVC LISDFYPGAVTVAWKADSSPVKAGVETTTPSKQSNNKYAASSYLSLTPEQWKSHRSYSCQVTHEGSTVEKTVAPTECS | LC (with N-terminal Signal sequence) |
| 2923 | C135 | ATGAGGGCTTGGATCTTCTTTCTGCTCTGCCTGGCCGGGAGAGCGCTCGCACAGGTGCAGCTGGTGGAGTCTG GGGGAGGCGTGGTCCAGCCTGGGAGGTCCCTGAGACTCTCCTGTGCAGCCTCTGGATTCACCTTCAGTAGCTAT GCTATGCACTGGGTCCGCCAGGCTCCAGGCAAGGGGCTGGAGTGGGTGGCAGTTATACCATTTGATGGAAGA AATAAGTACTACGCAGACTCCGTGACGGGCCGATTCACCATCTCCAGAGACAATTCCAAGAACACACTGTATCT GCAAATGAACAGCCTGAGAGCTGAGGACACGGCTGTGTATTACTGTGCGAGTAGTAGTGGTTATC1111CCACT CTGACTACTGGGGCCAGGGAACCCTGGTCACCGTCTCCTCAGCTAGCACCAAGGGCCCATCGGTCTTCCCCCTG GCACCCTCCTCCAAGAGCACCTCTGGGGGCACAGCGGCCCTGGGCTGCCTGGTCAAGGACTACTTCCCCGAACC GGTGACGGTGTCGTGGAACTCAGGCGCCCTGACCAGCGGCGTGCACACCTTCCCGGCTGTCCTACAGTCCTCAG GACTCTACTCCCTCAGCAGCGTGGTGACCGTGCCCTCCAGCAGCTTGGGCACCCAGACCTACATCTGCAACGTG AATCACAAGCCCAGCAACACCAAGGTGGACAAGAGAGTTGAGCCCAAATCTTGTGACAAAACTCACACATGCC CACCGTGCCCAGCACCTGAACTCCTGGGGGGACCGTCAGTCTTCCTCTTCCCCCCAAAACCCAAGGACACCCTCA TGATCTCCCGGACCCCTGAGGTCACATGCGTGGTGGTGGACGTGAGCCACGAAGACCCTGAGGTCAAGTTCAA CTGGTACGTGGACGGCGTGGAGGTGCATAATGCCAAGACAAAGCCGCGGGAGGAGCAGTACAACAGCACGTA CCGTGTGGTCAGCGTCCTCACCGTCCTGCACCAGGACTGGCTGAATGGCAAGGAGTACAAGTGCAAGGTCTCC AACAAAGCCCTCCCAGCCCCCATCGAGAAAACCATCTCCAAAGCCAAAGGGCAGCCCCGAGAACCACAGGTGT ACACCCTGCCCCCATCCCGGGAGGAGATGACCAAGAACCAGGTCAGCCTGACCTGCCTGGTCAAAGGCTTCTAT CCCAGCGACATCGCCGTGGAGTGGGAGAGCAATGGGCAGCCGGAGAACAACTACAAGACCACGCCTCCCGTG CTGGACTCCGACGGCTCCTTCTTCCTCTATAGCAAGCTCACCGTGGACAAGAGCAGGTGGCAGCAGGGGAACG TCTTCTCATGCTCCGTGCTGCATGAGGCTCTGCACAGCCACTACACGCAGAAGAGCCTCTCCCTGTCCCCGGGTT GA | HC (with N-terminal Signal sequence) |

TABLE 14-continued

Additional representative sequences of the example antibodies as disclosed

| SEQ ID NO | Anti-body | Sequence | Notes |
|---|---|---|---|
| 2924 | C135 | ATGAGGGCTTGGATCTTCTTTCTGCTCTGCCTGGCCGGGCGCGCCTTGGCCGACATCCAGATGACCCAGTCTCCT TCCACCCTGTCTGCATCTGTAGGAGACAGAGTCACCATCACTTGCCGGGCCAGTCAGAGTATTAGTAACTGGTT GGCCTGGTTTCAGCAGAAACCAGGGAAAGCCCCTAAGCTCCTGATCTATGAGGCGTCTAGTTTAGAAAGTGGG GTCCCATCAAGGTTCAGCGGCAGTGGATCTGGGACAGAATTCACTCTCACCATCAGCAGCCTGCAGCCTGATGA TTTTGCAACTTATTACTGCCAACAGTATAATAGTTATCCGTGGACGTTCGGCCAAGGGACCAAGGTGGAGATCA AACGTACGGTGGCTGCACCATCTGTCTTCATCTTCCCGCCATCTGATGAGCAGTTGAAATCTGGAACTGCCTCTG TTGTGTGCCTGCTGAATAACTTCTATCCCAGAGAGGCCAAAGTACAGTGGAAGGTGGATAACGCCCTCCAATCG GGTAACTCCCAGGAGAGTGTCACAGAGCAGGACAGCAAGGACAGCACCTACAGCCTCAGCAGCACCCTGACGC TGAGCAAAGCAGACTACGAGAAACACAAAGTCTACGCCTGCGAAGTCACCCATCAGGGCCTGAGCTCGCCCGT CACAAAGAGCTTCAACAGGGGAGAGTGTTAG | LC (with N-terminal Signal sequence) |
| 2925 | C144' | ATGAGGGCTTGGATCTTCTTTCTGCTCTGCCTGGCCGGGAGAGCGCTCGCAGAGGTGCAGCTGGTGGAGTCTG GAGGAGGCTTGATCCAGCCTGGGGGGTCCCTGAGACTCTCCTGTGCAGCCTCTGGGTTCACCGTCAGTAACAAC TACATGAGCTGGGTCCGCCAGGCTCCAGGGAAGGGGCTGGAGTGGGTCTCAGTTATTTATGCGGTGGTAGCA CATACTACGCAGACTCCGTGAAGGGCCGATTCACCATCTCCAGAGACAAATCCAAGAACACGCTGTATCTTCAA ATGAACAGCCTGAGAGCCGAGGACACGGCCGTGTATTATTGTGCGAGAGAAGGGGAGGTAGAAGGGTATAAC GATTTTTGGAGTGGTTATTCTAGAGACCGTTACTACTTTGACTACTGGGGCCAGGGAACCCTGGTCACCGTCTCC TCAGCTAGCACCAAGGGCCCATCGGTCTTCCCCCTGGCACCCTCCTCCAAGAGCACCTCTGGGGGCACAGCGGC CCTGGGCTGCCTGGTCAAGGACTACTTCCCCGAACCGGTGACGGTGTCGTGGAACTCAGGCGCCCTGACCAGC GGCGTGCACACCTTCCCGGCTGTCCTACAGTCCTCAGGACTCTACTCCCTCAGCAGCGTGGTGACCGTGCCCTCC AGCAGCTTGGGCACCCAGACCTACATCTGCAACGTGAATCACAAGCCCAGCAACACCAAGGTGGACAAGAGAG TTGAGCCCAAATCTTGTGACAAAACTCACACATGCCCACCGTGCCCAGCACCTGAACTCCTGGGGGGACCGTCA GTCTTCCTCTTCCCCCCAAAACCCAAGGACACCCTCATGATCTCCCGGACCCCTGAGGTCACATGCGTGGTGGTG GACGTGAGCCACGAAGACCCTGAGGTCAAGTTCAACTGGTACGTGGACGGCGTGGAGGTGCATAATGCCAAG ACAAAGCCGCGGGAGGAGCAGTACAACAGCACGTACCGTGTGGTCAGCGTCCTCACCGTCCTGCACCAGGACT GGCTGAATGGCAAGGAGTACAAGTGCAAGGTCTCCAACAAAGCCCTCCCAGCCCCCATCGAGAAAACCATCTC CAAAGCCAAAGGGCAGCCCCGAGAACCACAGGTGTACACCCTGCCCCCATCCCGGGAGGAGATGACCAAGAA CCAGGTCAGCCTGACCTGCCTGGTCAAAGGCTTCTATCCCAGCGACATCGCCGTGGAGTGGGAGAGCAATGGG CAGCCGGAGAACAACTACAAGACCACGCCTCCCGTGCTGGACTCCGACGGCTCCTTCTTCCTCTATAGCAAGCT CACCGTGGACAAGAGCAGGTGGCAGCAGGGGAACGTCTTCTCATGCTCCGTGCTGCATGAGGCTCTGCACAGC CACTACACGCAGAAGAGCCTCTCCCTGTCCCCGGGTTGA | HC (with N-terminal Signal sequence) |
| 2926 | C144' | ATGAGGGCTTGGATCTTCTTTCTGCTCTGCCTGGCCGGGCGCGCCTTGGCCCAGTCTGCCCTGACTCAGCCTGCC TCCGTGTCTGGGTCTCCTGGACAGTCGATCACCATCTCCTGCACTGGAACCAGCAGTGACGTTGGTGGTTATAA CTATGTCTCCTGGTACCAACAACACCCAGGCAAAGCCCCCAAACTCATGATTTATGATGTCAGTAATCGGCCCTC AGGGGTTTCTAATCGCTTCTCTGGCTCCAAGTCTGGCAACACGGCCTCCCTGACCATCTCTGGGCTCCAGGCTGA GGACGAGGCTGATTATTACTGCAGCTCATATACAAGCAGCAGCACCCGAGTCTTCGGAACTGGGACCAAGGTC ACCGTCCTAGGTCAGCCCAAGGCTGCCCCCTCGGTTACCCTGTTCCCGCCCTCCTCTGAGGAGCTTCAAGCCAAC AAGGCCACACTGGTGTGTCTCATAAGTGACTTCTACCCGGGAGCCGTGACAGTGGCCTGGAAGGCAGATAGCA GCCCCGTCAAGGCGGGAGTGGAGACCACCACACCCTCCAAACAAAGCAACAACAAGTACGCGGCCAGCAGCTA TCTGAGCCTGACGCCTGAGCAGTGGAAGTCCCACAGAAGCTACAGCTGCCAGGTCACGCATGAAGGGAGCACC GTGGAGAAGACAGTGGCCCCTACAGAATGTTCATAG | LC (with N-terminal Signal sequence) |

CDR sequences are identified based on the IMGT Kabat method.

TABLE 15

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| COV21_P2 A10 | A-C003 | TACACATACGATTTAGGTG ACACTATAGAATAACATCC ACTTTGCCTTTCTCTCCACA GGTGTCCACTTCCCAGGTCC AACTGCACCTCGGTTCTATC GATTGAATTCCACCATGGA ATGGTCATGTATCATCCTTT TTCTAGTAGCAACTGCAAC CGGTGTACATTCTGAGGTG CAGCTGGTGGAGTCTGGAG GAGGCTTGATCCAGCCTGG GGGGTCCCTGAGACTCTCC TGTGCAGCTCTGGGTTCAC CGTCAGTAGCAACTACATG AGCTGGGTCCGCCAGGCTC CAGGGAAGGGGCTGGAGTG GGTCTCAGTTATTATAGCG GTAGCACATAACTACGC AGACTCCGTGAAGGGCCGA TTCACCATCTCCAGAGACA ATTCCAAGAACACGCTGTA TCTTCAAATGAACAGCCTG AGAGCCGGGACACGGCCG TGTATTACTGTGCGAGGGA TTACGGTGACTTCTACTTTG ACTACTGGGGCCAGGGAAC CCTGGTCACCGTCTCCTCAG CGTCGACCAAGGGCCCATC GGTCTTCCCCCTGGCACCCT CCTCCAAGAGCACCTCTGG GGGCACAGCGGCCCTGGGC TGCCTGGTCAAGGACTACT TCCCCGAACCTGTGACGGT CTGACGGCCGTGCACA CCTTCCCGGCTGTCTACAG TCCTCANGACTCTACTCCCT CAGCAGCGTGGTGACCGTG CCCTCCAGCAGCTTGGGCA CCCAGACCTACATCTGCAA CGTGAATCACAAGCCCAGC AACACCNANGTGGACAAGA GAGTTGAGCCCAAATCTTG | GAGGTGCTCTTGGAGGAGG GTGCCAGGGGAAGACCGA TGGGCCCTTGGTGGAGGCT GAGAGACGGTGACCAGGG TTCCCTGGCCCCAGTAGTCA AAGTAGAAGTCACCGTAAT CCCTCGCACAGTAATACAC GGCCGTGTCCCCGGCTCTC AGGTGTTCATTTGAAGAT ACAGCGTGTTCTTGGAATT GTCTCTGGAGATGGTGAAT CGGCCCTTCACGGAGTCTG CGTAGTATGTGCTACCACC GCTATAAATAACTGAGACC CACTCCAGCTCCCTTCCTGG AGCTGGCCGGACCCAGCTC ATGTAGTTGCTACTGACGG TGAACCCAGAGGCTGCACA AGAGAGTCTCAGGGACCCG CCAGGCTGGATCAAGCCTC CTCCAGACTCCACCAGNCT GCAC (SEQ ID NO: 3243) | COV21_P2 A10 | TACACATACGATTTAGGT GACACTATAGAATAACA TCCACTTTGCCTTTCTCT CCACAGGTGTCCACTCCC AGGTCCAACTGCACCTC GGTTCTATCAGATTTCAACTG CTCATCAGATGGCGGAAG ATGAAGACAGATGTGCAG CCACAGTTCGTTTGATCTCC GTAGCAACTGCAACCGG GTAGCAACTGCAACCGG AGTCCTAGGTGAGCTACCAT ACTGCTGACAGTAATACACT GCAAAATCTTCAGGCTCCAG TCTGCTGATGGTGAGACTGA AGTCGTCCCAGACCCACTG CCACTGAACCTGTCTGGGAT GCCAGTGCCCTGCTGATG CACCATAGATGAGGAGCCT CTCCCAGGTCCTCATCT GGGAGCCTGGCCAGGTTCT GCTGGTACCAGGCTAAGTA GGTGCTGCTAACACTCTGAC TGGCCCTGCAGGAGAGGT GGCTCTTTCCCTGGAGACA AAGACAGGAGACTGGA (SEQ ID NO: 3245) | COV21_P2 A10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | TGACAAAACTCACACATGC CCACCGTGCCCAGCACCTG AACT (SEQ ID NO: 3242) | | | CCTGCGAAGTCACCCAT C (SEQ ID NO: 3244) | | |
| COV21_P1 G2 | A-C007 | TACACATACGATTTAGGTG ACACTATAGAATAACCA ACTTTGCCTTTCTCTCCACA GGTGTCCACTCCCAGGTCC AACTGCACCTCGGTTCTATC GATTGAATTCACCAGTGGG ATGGTCATGTATCATCCTTT TTCTAGTAGCAATGCAAC CGGTGTGTACATTCTGAGGTG CAGCTGGTGGAGTCTGGGG GAGGCTTGGTAAAGCCTGG GGGGTCCCTTAGACTCTCCT GTGCAGCCTCTGGATTCACT TTCAGTAACGCCCTGAGA ACTGGGTCCGCCAGGCTCC AGGGAAGGGGCTGAGTGG GTTGCCGTATTAAAGACA AATCTGATGTGGGACAAT AGACTACGCTCACCGTG CAAGGCAGATTCACCATCT CAAGAGATGATTCAAAAA CACGCTGTATCTGCAAATG AACAGCCTGAAAACCGAGG ACACAGCCGTGTATTACTG TACCACAGGCCCTCACTAT GATGATTCTGGTTATTCGTA CACTGTTGACTACTGGGGC CAGGGAACCCTGGTCACCG TCTCCTCAGCGGTGACCA AGGGCCATCGGTCTTCCC CCTGCACCCTCCTCCAAG AGCACCTCTGGGGCACAG CGGCCCTGGGCTGCCTGGT CCTGTGACCTTCCCTGA ACTCANGCGCCTGACCAG CGGCGTCCTACCTCCCG GCTGCTGTCCCTACAGTCCTCAN GACTTCTCCCTCAGCAG CGTGGTGACCGTGCCCTCC | NGAGGTGCTCTTGGAGGAG GGTGCCAGGGGGAAGACCG ATGGGCCCTTGGTGGAGGC TGAGGAGACGGTGACCAGG GTTCCCTGGCCCCAGTAGTC AACAGTGTACGAATAACCA GAATCATCATAGTGAGGGC CTGTGGTACAGTAATACAC GGCTGTGTCCTCGGTTTCA GGCTGTTCATTTGCAGATAC AGCGTGTTTTTTGAATCATC TCTTGAGATGGTGAATCTG CCTTGCACGGGTGCAGCGT AGTCTATTGTCCCACCATCA GATTGTCTTTAATACGGCC AACCCACTCCAGCCCCTTCC CTGAGCCCTGGCGACCCA GTTCATCCAGGCGTTACTG AAAGTACAGCTCAGAGGCTG CACAGGAGAGTCTAAGGAA CCCCCAGGCTTTACCAAG CCTGCCCAGACTCCACCA GCTGCACNT (SEQ ID NO: 3247) | COV21_P1 G2 | TACACATACGATTTAGGT GACACTATAGAATAACCA TCCACTTTGCCTTTCTCT CCACAGGTGTCCACTCCC AGGTCCAACTGCACCTC GGTTCTATCCAGATTTCAACTG CTCATCAGATGGCGGAAG ATGAAGACAGATGGTGCA CCACAGTTCGTTTGATCTCC ACCTTGGTCCCTCCGCCGAA GTAGGGGAGTTTGTAGA GCTTGCATGCAGTAATAAAC CCCAAACATCCTCAGCCTCCA CTCTGCTGATTTTCAATGTA AAATCTGCCTGATCCACT GCCACTGAACCTGTCAGG ACCCCGAGGCCCGATTAG AACCCACATAGATCAGGAG CTGTGGAGTCTGCCCCTGCT TCTCAGTACCAATCCAAA AAGTGAATCCATTACTATG CAGGAGCTCTGACTAGAC CTGCAGAGATGGAGGCCG GCTCTCCAGGGGTGACGGG CAGGGAGANTGA (SEQ ID NO: 3249) | | COV21_P1 G2 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AGCAGCTTGGGCACCCAGA CCTACATCTGCAACGTGAA TCACAAGCCCAGCAACACC AA (SEQ ID NO: 3246) | | | ACAGCCTCAGCAGCACC CTGACGCTGAGCAAGC AGACTACGAGAAACACA AAGTCTACGCCTGCGAA GTCACCCAT (SEQ ID NO: 3248) | | |
| COV21_P1 H9 | A-C008 | TACACATACGATTTAGGTG ACATTATAGAATAACATCC ACTTTGCCTTTCTCTCCACA GGTGTCCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCTGAGGTG CAGCTGGTGGAGTCTGGGG GAGGCGTCCCTGCAGCCTGG GGGTCCCTGAGACTCTCC TGTGCAGCCTCTGGATTCAC CTTCAGTAGCTATGGCATG CACTGGGTCCGCCAGGCTC CAGGCAAGGGCTGGAGTG GGGTGACAGTTATTTCATATG ATGGAAGGAATAAATACTA TGCAGACTCCGTGAAGGGC CGATTCACCATCTCCAGAG ACAACTCCAAGAACACGCT GTATCTGCAAATGAACAGC CTGAGAGCTGACGACACGG CTGTGTATTACTGTGCGAG AGAATTCGGTGACCCTGAG TGGTACTTTGACTACTGGG GCCAGGGAACCCTGGTCAC CGTCTCCTCAGCGTCTTCC AAGGGCCCATCGGTCTTCC CCCTGGCACCCTCCTCCAA GAGCACCTCTGGGGCACA GCGGCCCTGGGCTGCCTGG TCAAGGACTACTTCCCCGA AACTCNGCGCCCTGACCAG CGCTGTCCTACAGTCTCNN ACTCTACTCCCTCAGCAGC | CGCTGTGCCCCNGAGGTGC TCTTGGAGGAGGGTGCCAG GGGGAAGACCGATGGGCCC TTGGTGGAGGCTGAGGAGA CGGTGACCAGGGTTCCCTG GCCCCAGTAGTCAAAGTAC CACTCGGGGTCACCGAAT CTCTCGCACAGTAATACAC AGCCGTGTCCTCAGCTCTCA GGCTGTTCATTTGCAGATAC AGCGTGTTCTTTGGAGTTGTC TCTGAGATGGTGAATCGG CCCTTCACGGAGTCTGCAT AGTATTATTCCTTCCATCA TATGAAATAACTGTCACCC ACTCCAGCCCCTTGCTCACC CAGCAAGGGCTGACCTGG GGTGACAGTTATTTCATATG ATGCCATAGCTACTGAAGG TGAATCCAGAGGCTGCACA GGAGAGTCTTCAGGAGCTC CCAGCTGCACCACCTC CCCCAGACTTCCACCAGTG CACCTANNANGNAAACC (SEQ ID NO: 3251) | COV21_P1 H9 | TACACATACGATTTAGGT GACATTATAGAATAACA TCCACTTTGCCTTTCTCT CCACAGGTGTCCACTCCC AGTCCAACTGCACCTC GGTTCTATCGATTGAATT CCACCATGGAGATGGTCA TGTATCATCCTTTTTCTA GTAGCAACTGCAACGG TGTACATTCTGACATCCA GATGACCCAGTCTCCTTC CACCCTGTCTGCATCTGT AGGAGACAGAGTCACCA TCACTTGCCGGGCCAATC AGAGTATTAGTAGCTGG TTGCCTGGTATCCAGA GAAACAGGGAAAGCCC CTAAGCTCCTGATCTATA AGGCGTCTAGTTTAGAA AGTGGGGTCCCATCAAG GTTCAGCGGCAGTGGAT CTGGGACAGAATTCACT CTCACCATCAGCAGCCT GCAGCCTGATGATTTTGC AACTTATTACTGCCAACA GTATAATAGTTATTGGAC GTTCGGCCAAGGGACCA AGGTGGCTGCACCATC ACGTGGCTGCACCATC TGTCTTCATCTTCCCGCC ATCTGATGAGCAGTTGA AATCTGGAACTGCCTCTG TTGTGTGCCTGCTGAATA ACTTCTATCCCAGAGAG GCCAAAGTACAGTGGAA GGTGGATAACGCCCTCC AATCGGGTAACTCCCAG GAGAGTGTCACAGAGCA | TGGGANTACCCGATTGGAG GGCGTTATCCACCTTCCACT GTACTTTGGCCTTCTCTGGA TAGAAGTTATTCAGCAGGCA CACAACAGAGGCAGTTCCA GATTTCAACTGCTCATCAGA TGGCGGGAAGATGAAGACA GATGGTGCAGCCACAGTTCG TTTGATTTCCACCTTGGTCC CTTGGCCGAACGTCCAATAA CTATTATACTGTTGGCAGTA ATAAGTTGCAAAATCATCAG GCTGCAGCCTGCTGATGTG AGAGTGAATTCTGTCCAGA TCCACTGCCGCTGAACCTTG ATGGACCCCACCTTTCTAAA CTAGACGCCTTTATAGATCAG GAGCTTAGGGGCTTTCCCTG GTTTCTGTGATACCAGCC AACCAGCTACTAATACTCTG ATTGGCCCGGCCAAGTGATG GTGACTCTGTCTCCTACAGA TGCAGACAGGGNGANTGNA NNNNGGGGTCAT (SEQ ID NO: 3253) | COV21_P1 H9 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | GTGGTGACCGTGCCCTCCA GCAGCTTGGGCACCCAGAC CTACATCTGCAACGTGAAT CACAAGCCCAGCAACACCA AGNTGGANAGAGAGTTGAG CCCAAATCTTGTGAC (SEQ ID NO: 3250) | | | GGACAGCAAGGACAGCA CCTACAGCCTTCAGCAGC ACCCTGACGCTGANCAA AGCAGACTACGAGAAAC ACAAAGTCTACGCCTGC GAAGTCACCCATCNGGN CTGAGCTCGCCCGTCAC AAAGAGCTTCAAC (SEQ ID NO: 3252) | | |
| COV21_P1 H7 | A-C010 | TACACATACAGATTAGGTG ACACTATAGAATAACATCC ACTTTGCCTTTCTCCACA GGTGTCCACTCCCAGGTCC AACTGCACCTCGGTTCTATC GATTGAATTCCACCATGG ATGGTCATTGTATCATCCTTT TTCTAGTAGCAACTGCAAC CGGTGTACATTCTGAGGTG CAGCTGGTGGAGTCTGGGG GAGGCGTGGTCCAGCCTGG GAGGTCCCTGAGACTCTCC TGTGCAGCCTCTGGATTCAC CTTACAGTAGCTATGCTATGC ACTGGGTCCGCCAGGCTCC AGCCAAGGGCTGGAGTGG GTGTCAGTTATTATATATG ATGGAAGCGGTAAATACTA CGCAGACTCCGTGAAGGGC CGATTCACCATCTCCAGAG ACAATTCCAAGAACACGTT GTATCTGCAAATGAACAGC CTGAGAGCTGAGGACACGG CTGTGTATTACTGTGCGAG AGACGGGATCGTGGATACA GCTCTGGTTACGTGGTTTGA CTACTGGGGCCAGGGAACC CTGGTCACCGTCTCCTCAGC GTCGACCAAGGGCCCATCG GTCTTCCCCCTGGCACCCTC CTCCAAGAGCACCTCTGGG GGCACAGCGGCCCTGGGCT GCCTGGTCAAGGACTACTT CCCCGAACCTGTGACGGTC TCGTGGAACTCNNCGCCCT | GAGGTGCTCTTGGAGGAGG GTGCCAGGGGGAAGACCGA TGGGCCCTTGGTGAGGCT GAGGAGACGGTGACCAGGG TTCCCTGGCCCCAGTAGTCA AACCACGTAACCACGAGCTG TATCCACGATCATCCGTCTC GCACAGTAATACACAGCCG TGTCCTCAGCTCTCAGGCTG TTCATTTGCAGATACAACGT GTTCTTGGAATTGTCTCTGG AGATGGTGAATCGGCCCTT CACGGAGTCTGCGTATAT TTACCGCCTTCATCATATAA TATAACTGCCACCACTCC AGCCCCTTGCCTGGAGCCT GGCGACCCAGTGCATAGC ATAGCTACTGAAGGTGAAT CCAGAGGCTGCACAGGAGA GTCTCAGGGACCTCCCAGG CTGACCACCACGCCTCCCCA GACTCCACCAGGCTGCACC T (SEQ ID NO: 3255) | COV21_P1 H7 | TACACATACAGATTAGGT GACACTATAGAATAACA TCCACTTTGCCTTTCTCT CCACAGGTGTCCACTCCC AGGTTCCAACTGCACCTC GGTTCTATCGATTGAATT CCACCATGGGATGGTCA TGTATCATCCTTTTTCTA GTAGCAACTGCAACCGG TGTACATTCAGACAATCCA GTTGACCCAGTCTCCATC CTCCCTGTCTGCATCTGT AGGAGACAGATCCACCA TCACTTGCCGGGCAGT CAGAGCATTAGCACCTA TTTAAATTGGTATCAGCA GAAACCAGGGAAAGCCC CTAAGCTCCTGATCTATG CTGCATCCAGTTTGCAAA GTGGGGTCCCATCAAGG TTCAGTGCAGTGAGTCT GGGACAGATTTCACTCTC ACCATCAGCAGTCTGCA ACTTGAAGATTTTGCAA CTTACTACTGTCAACAGA GTTACAGTACCCCTCCGT GGACGTTCGGCCAAGGG ACCAAGGTGGAGATCAA ACGTACGGTGGCTGCAC CATCTGTCTTCATCTTCC CGCCATCTGATGAGCAG TTGAAATCTGGAACTGC CTCTGTTGTGTGCCTGCT GAATAACTTCTATCCCAG AGAGCCAAAGTACAGT | CGATTGGAGGGCGTTATCCA CCTTCCACTGTACTTTGCC TCTCTGGATAGAAGTATT CAGCAGGCACACAACAGAG GCAGTTCCAGATTTCAACTG CTCATCAGATGGCGGGAAG ATGAAGACAGATGGTCAG CCACAGTTCGTTTGATTTCC ACCTTGTCCCTTGGCCGAA CGTCCACGGAGGGGTACTGT AACTCTGTTGACAGTAGTAA GTTGCAAAATCTTCAGGTTG CAGACTGCTGATGGTGAGA GTGAAATCGTGTCCAGATGC ACTGCCACTGAACCTTGATG GGACCCACTTTGCAAACTG GATGCAGCATAGATCAGGA GCTTAGGGCTTTCCCTGGT TTCTGCTGATACCAATTTAA ATAGGTGCTAATGCTCTGAC TTGCCCGGCCAAGTGATGGTG ACTCTGTCTCCTACAGATGC AGACAGGGAG (SEQ ID NO: 3257) | COV21_P1 H7 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | GACCAGCGCGGCGTGCACACC TTCCCGGCTGTCTCCTACAGTC CTCNNNCTCTACTCCCTCAG CAGCCTGTGACCGTGCCC TCCAGCAGCTTGGCACCC AGACCCTGACATCTGCAACGT GAATCACAAGCCCAGCAAG ACCAAG (SEQ ID NO: 3254) | | | GGAAGGTGGATAACGCC CTCCAATCGGTAACTCC CAGGAGAGTGTCACAGA GCAGGACAGCAAGGACA GCACCTACAGCCTCAGC AGACCCTGACGCTGAG CAAAGCAGTACGAGA AACACAAAGTCTACGCC TGCGAAGTCACCCATCN GGCCNTGAGCTCGCCG TCACAAAGAGCTTCAAC AGGGGAGAGTGTTAGAA GCTTGGCCGCCATGGCC CAACTTGTTATTGCAGC TTAT (SEQ ID NO: 3256) | | |
| COV21_P2 B7 | A-C001 | TACACATACGATTTAGGTG ACACTATAGAATAACATCC ACTTTGCCTTTCTCCAGGTC GGTGTCCACTCCCAGGTCC AACTGCACCTCGGTTCTATC GATTGAATTCCACCATGG GCCCCAGTAGTCAAAGGCC ACCACACTACAATATCAG ATGGTCATGTATCATCCTTT TTCTAGTAGCAACTGCAAC CGGTGTACATTCTGAGGTG CAGCTGGTGGAGTCTGGG GAGGCGTGGTCCAGCCTGG GAGGTCCCTGAGACTCTCC TGTGCAGCCTCTGATTCAC CTTCAGTATCTATGGCATGC ACTGGTCCGCCAGGCTCC AGGCAAGGGGCTGGAGTGG GTGGCAGTTATATAAATACTA ATGGAAGTAATAAATACTA TGCAGACTCCGTGAAGGGC CGATTCACCATCTCCAGAG ACAATTCCAAGAACACGCT GTATCTGCAAATGAACAGC CTGAGAGCCGAGGACACGG CTGTGTATTACTGTGCGAA AGAGGGGAGACCATCTGAT ATTGTAGTGTGGGGCCCTT TGACTACTGGGGCCAGGGA ACCCTGGTCACCGTCTCTC | CNCTGTGCCCCAGAGGTGC TCTTTGGAGGAGGGTCCAG GGGAAGACCGATGGCCAG TTGGTGGAGGCTGAGGAGA CGGTGACCAGGGTTCCTG GCCCCAGTAGTCAAAGGCC ACCACACTACAATATCAG ATGGTCATGTATCATCCTT TTCTAGTAGCAACTGCAAC CAGTAATAACAGCCGTGT CCTCAGCTCTCAGGCTGTTC ATTTGCAGATACAGCGTGT TCTTTGGAATTGTCTCTGAG ATGGTGAATCGGCCCTTCA CGGAGTCTGCATAGTATTT ATTACTTCCATCATATGATA TAACTGCCACCCACTCCAG CCCCTTGCCTGGAGCCTGG CGGACCCAGTGCATGCCAT AGATACTGAAGGTGAATCC AGAGGCTGCACAGGAGAGT CTCAGGGACCTCCCAGGCT GGACCACGCCTCCCCCAGA CTCCACCAGCTGCA (SEQ ID NO: 3259) | COV21_P2 B7 | ATTGGAGGGCGTTATCCACC TTCCACTGTACTTTGGCCTC TCTGGGATAGAAGTTATTCA GCAGGCACACAACAGAGGC AGTTCCAGATTTCAACTGCT CATCAGATGGCCGGAAGAT GAAGACAGATGGTGCAGCC ACAGTTCGTTTGATTTCCAC CTTGGTCCCTTGCCGAACG TCCGAGGGGTACTGTAACTC TGTTGACCAGTAGTAAGTTGC AAAATCTTCAGGTTGCAGAC TGCTGATGGTGAGAGTGAA ATCTGTCCCAGATCCACTGC CACTGAACCTTGATGGGACC CCACTTTGCAAACTGGATGC AGCATAGATCAGGAGCTTA GGGGCTTTCCCTGGTTTCTG CTGATACCAATTTAAATAGC TGCTAATGCTCTGACTTGCC CGGCAAGTGATGGTGACTCT GTCTCCTACAGATGCAGACA GGGAGANTGGAG (SEQ ID NO: 3261) | COV21_P2 B7 |

TABLE 15-continued

Additional sequence information for the disclosed anti-SARS-CoV-2 antibodies

| | | HEAVY CHAIN | | | LIGHT CHAIN | | |
|---|---|---|---|---|---|---|---|
| ALICE | AbsID | miniprep sequence | original nt sequence | sequence ID (plate/well) | miniprep sequence | original nt sequence | sequence ID (plate/well) |
| | | AGCGTGACCAAGGGCCCA TCGGTCTTCCCCCTGGCACC CTCCTCCAAGAGCACCTCT GGGGGCACAGCGGCCCTGG GCTGCCTGGTCAAGGACTA CTTCCCCGAACCTGTGACG GTCTCTGTGGAACTCAGNCG CCCTGACCAGCGGCGTGCA CACCTTCCCGGCTGTCCTAC AGTCCTC (SEQ ID NO: 3258) | | | GTACGGTGGCTGCACCA TCTGTCTTCATCTTCCCG CCATCTGATGAGCCAGT GAAATCTGAACTGCCT CTGTTGTGTGCCTGCTGA ATAACTTCTATCCCAGAG AGGCCAAAGTACAGTGG AAGGTGGATAACGCCCT CCAATCGGGTAACTCCC AGGAGAGTGTCACAGAG CAGGACAGCAAGGACAG GCACCCTGACGCTGAGC AAGCAGACTACGAGAA ACACAAAGTCTACGCCT GCGAAGTCACCCATCAG GGCCTGAGCTCGCCCGT CACAAAGAGCTTCAACN GGGGAGAGTGTTAGAAG CTTGGCCCGCCATGGCCC AACTGTTTATTGCAGCT TATAAT (SEQ ID NO: 3260) | | |
| COV21_P2 F6 | A-C002 | TACACCATACGATTAGGTG ACACTATAGAATAACATCC ACTTTGCCTTTCTCCACA GGTGTCCACTCCCAGGTCC AACTGCACCTCGGTTCTATC GATTGAATTGCACCATGG ATGGTCATGTATCATCCTTT TTCTAGTAGCAACTGCAAC CGGTGTACATTCTGAGGTG CAGCTGGTGGAGTCTGGGG GAGGCGTGGTCCAGCCTGG GAGGTCCCTGAGACTCTCC TGTGCAGCCTCTGGATTCAC CTTCAGTATCTATGGCATGC ACTGGGTCCGCCAGGCTCC AGGCAAGGGGCTGGAGTGG GTGGCAGTTATATCATATG ATGGAAGTAATAAATACTA TGCAGACTCCGTGAAGGGC CGATTCACCATCTCCAGAG ACAATTCCAAGAACACGCT GTATCTGCAAATGAACAGC | GCTNNGCNCCNNANGTGCT CTTGGAGGNNGGTGCCAGG GGGAAGACCCATGGGCCCT TGGTGGAGGCTGAGAGAC GGTGACCACTCCCAGGTCG AACTGCACCTCGGTTCTATC GATTGAATTCGCACCATGG ATGGTCATGTATCATCCTTT TTCTAGTAGCAACTGCAAC CGGTGTACATTCTGAGGTG CAGCTCTTCAGGCTGTTCA TTTGCAGATACAGCCGTGTTC TTGGAATTGTCTCTGGAGAT GGTGAATCGGCCTTCACG TGTGCAGCCTCTGGATTCAC CTGGGTCGCCAGGCTCC AGGCAAGGGGCTGGAGTGG GTGGCAGTTATATCATATG ATGGAAGTAATAAATACTA TGCAGACTCCGTGAAGGGC CGATTCACCATCTCCAGA GACAATTCCAAGAACACGCT GTATCTGCAAATGAACAGC | COV21_P2 F6 | TACACATACGATTAGGT GACACTATAGAATAACA TCCACTTTGCCTTTCTCT CCCAGGTGTCCACTCCC AGTCCAACTGCACCTC GGTTCTATCGATTGAATT CCACCATGGGATGTCA TGTATCAATCCTTTTTCTA GTAGCAACTGCAACCA TGTACATTCAGACATCCA GTTGACCCAGTCTCCATC CTCCCTGTCTGCATCTGT AGGAGACAGTCACCA TCACTTGCCGGGCAAGT CAGAGCATTAGCAGCTA TTTAAATTGGTATCAGCA GAAACCAGGGAAAGCCC CTAAGCTCCTGATCTATG CTGCATCCAGTTTGCAAA GTGGGGTCCCATCAAGG TTCAGTGGCAGTGGATCT GGGACAGATTTCACTCTC | CNGGGANTACCCGATTGG AGGGCGTTATCCACCTTCCA CTGTACTTTGGCCTCTCTGG GATAGAAGTTATTCAGCAG GACACAACAGAGGCAGTT CCAGATTTCAACTGCTCATC AGATGGCGGGAAGATGAAG ACAGATGGCAGCCACAG TTCGTTTGATTTCCACCTTG GTCCCTTGGCCGAACGTCCG AGGGGTACTGTAACTCTGTT GACAGTAGTAAGTGCAAA ATCTTCAGGTTGCAGACTGC TGATGGTGAGAGTGAAATCT GTCCCAGATCCACTGCCACT TTTGCAAACTGGATGCAGCA GAACCTTGATGGGAGCTT TTTGCAAACTGGATGCAGCA TAGATCAGGAGCTTAGGGG CTTTCCCTGGTTTTCTGCTGAT ACCAATTAAATAGCTGCTA ATGCTGGCAGTGAATCT GTGGGGTCCCATCAAGG TTCAGTGGCAGTGGATCT GGGACAGATTTCACTCTC | COV21_P2 F6 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| COV21_P1 F12 | A-C004 | CTGAGAGCTGAGGACACGG CTGTGTATTACTGTGCGAA AGAGGGAGACCATCTGAT ATTGTAGTGGTGTGGCCTT TGACTACTGGGGCCAGGGA ACCCTGGTCACCGTCTCCTC AGCGTCGACCAAGGGCCCA TCGGTCTTCCCCCTGGCACC CTCCTCCAAGAGCACCTCT GGGGGCACAGCGGCCCTGG GCTGCCTGGTCAAGGACTA CTTCCCCGAACCTGTGACG GTCTCGTGGAACTCANGCG CCCTGACCAGCGGCGTGCA CACCTTCCCGGCTGTCCTAC AGTCCTCNNACTCTACTCCC TCAGCAGCGTGGTGACCGT GCCCTCCAGCTTGGGC ACCCAGACCTACATCTGCA ACGTGAATCACAAGCCCAG CAAACCNAAGGTGGACAA GAGAGTTGAGCCCAAATCT TGTGACAAACTCACACATG CCCACCGTGCCCACACCCT GAACTCCTGGGGGACCGT CAGTCTT (SEQ ID NO: 3262) | CACCAGCCTGCAC (SEQ ID NO: 3263) | | ACCATCAGCAGTCTGCA ACCTGAAGATTTTGCAA CTTACTACTGTCAACAGA GTTACAGTACCCCTCGG ACGTTCGGCCAAGGGAC CAAGGTGGAAATCAAAC GTACGGTGGCTGCACCA TCTGTCTTCATCTTCCCG CCATCTGATGAGCAGTT GAAATCTGGAACTGCCT CTGTTGTGTGCCTGCTGA ATAACTTCTATCCCAGAG AGGCCAAAGTACAGTGG AAGGTGGATAACGCCCT CCAATCGGGTAACTCCC AGGAGAGTGTCACAGAG CANGACAGCAAGGACAG CACCTACAGCCTCAGCA GCACCCTGACGCTGAGC AAAGCAGACTACGAGAA ACACAAAGTCTACGCCT GCGAAGTCACCCATC (SEQ ID NO: 3264) | CTACAGATGCAGACAGGA GANTGGANNNTGGG (SEQ ID NO: 3265) | COV21_P1 F12 |
| COV21_P1 F12 | A-C004 | TACACATACGATTTAGGT ACATATAGAATAACATCC ACTTTGCCTTTCTCTCCACA GGTGTCCACTCCCAGGTCC AACTGCACCTCGGTTCTATC GATTGAATTCCACCATGGG ATGGTATATCATCCTTT TTCTAGTAGCAACTGCGAAC CGGTGTACATTCCCAGGTG CAGCTGGTGCAGTCTGGG GCCCTCAGTGAAGGTCTCC TGCAAGGCTTCTGGATACA CCCTTCACCGGCTACTATATG GCATAGTTTGTGCCACCACT CACTGGGTGCGACAGGCCC CTGGACAAGGGTTGAGTG GATGGGATGATCAACCCT | GCTGTGCCCCAGAGGTGCT CTTGGAGGANGGTGCCAGG GGGAAGACCCGATGGGCCT TGGTGAGGCTGAGAGAC GGTGACCGTGGTCCCCTTTGC CCCAGACGTCCATGTAGTA GTAGTACCCACAGTCGTAG CCACTATATCCACGTGATG CTGGGCTCCGCACAGTAATA CACGGCCGTGTCGCCATCCG CTCAGCCTGCTCAGCTCCAT GTAGGCTGTGCTGATGGAC GTGTCCCTGTCATGTGA CCCTGCCCTGAAACTTCTGT GCATAGTTTTGTGCCACCACT CACTGGGTGCGACAGGCCC CTGGACAAGGGCTTGAGTG GATAGGGTTGATCCATCCC ATCCACTCCAAGCCCCTGTCC | COV21_P1 F12 | TACACATACGATTTAGGT GACACTATAGAATAACA TCCACTTTGCCTTTCTCT CCACAGGTGTCCACTCCC AGTCCAACTGCACCTC GGTTCTATCGATTGAATT CCACCATGGGATGGTCA TGTATCACTCTTTTTCTA GTAGCAACTGCAACCGG TGTACATTGTGCCACCCG GATGACCCAGTCTCCATC CTCCCTGTCTGCATCTGT AGGAGACAGAGTCACCA TCACTTGCCAGGCAGT CAGGACATTAGCAACTA TTTAAATTGGTATCAGCA GAAACCAGGGAAAGCC | CNNGGANTTNCCCGATTGG AGGGCGTTATCCACCTTCCA CTGTACTTTGGCCTCTCTGG GATAGAAGTTATTCAGCAG GCACACAACAGAGGCAGTT CCAGATTTCAACTGCTCATC AGATGGCCGGAAGATGAAG ACAGATGGTGCAGCCACAG TTCGTTTAAATCTCCAGTGT GTCCCTTGGCCGAAGGTGAT AGGGAGATTATCATACTGTT GACAGTAATATGTTGCAATA TCTTCAGCTGCAGGCTGCT GATGGTGAAAGTAAAATCT GTCCCAGATCCACTTCCACT TTTAAATTGGTATCAGCA GAAACCAGGGAAAGCC TTTCCAAATTGGATGCATCG | COV21_P1 F12 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | ATCAGTGGTGGCACAAACT ATGCACAGAAGTTTCAGGG CAGGGTCACCATGACACG GACACGTCCATCAGCACAG CCTACATGGAGCTGAGCAG GCTGAGATCTGACGACACG GCCGTGTATTACTGTGCGA GCCCAGCATCACGTGGATA TAGTGGCTACTACATGGAC TCTGGGCAAAGGGACACG GGTCACCGTCTCCTCAGCGT CGACCAAGGGCCCATCGGT CTTCCCCCTGGCACCCTCCT CCAAGAGCACCTCTGGGGG CACAGCGGCCCCTGGGCTGC CTGGTCAAGGACTACTTCC CCGAACCTGTGACGGTCTC GTGGAACTCAGGCGCCCTG ACCAGCGGCGTGCACACCT TCCCGGCTGTCCTACAGTCC TCAGGACTCTACTCCCTCAG CAGGCGTGGTGACCGTGCCC TCCAGCAGCTTGGGCACCC AGACCTACATCTGCAACGT GAATCACAAGCCCAGCAAC ACCAAGGTGGACAAGAGAG TTGAGCCCAAATCTTGTGA CAAAAC (SEQ ID NO: 3266) | AGGGGCCTGTCGCACCCAG TGCATATAGTAGCCGGTGA AGGTGTATCCAGAAGCCTT GCAGGAGACCCTTCACTGAG GCCCCAGGGTTCTTCACCTC AGCCCCAGATGCCACCAGC TGCACCT (SEQ ID NO: 3267) | | CTAAGCTCCTGATCTACG ATGCATCCAATTTGAA ACAGGGTCCCATCAAG GTTCAGTGGAAGTGAT CTGGGACAGATTTTACTT TCACCATCAGCAGCCTG CAGCCTGAAGATATTGC AACATATTACTGTCAAC AGTATGATAATCTCCCTA TCACCTTCCGCCAAGGG ACACGACTGGAGATTAA ACGTACGTGGCTGCAC CATCTGTCTTCATCTTCC CGCCATCTGATGAGCAG TTGAAATCTGAACTGC CTCTGTTGTGTGCCTGCT GAATAACTTCTATCCCAG AGAGGCCAAAGTACAGT GGAAGGTGGATAACGCC CTCCAATCGGTAACTCC CAGGAGAGTGTCACAGA GCAGGACAGCAAGGACA GCACCTACAGCCTCAGC AGCACCCTGACGCTGAG CAAAGCAGACTACGCC AACACAAAGTCTACGCC TGCGAAGTCACCCATCA GGGCCTGAGCTCCCCG TCACAAAGAGCTTCAAC AGGGGAGAGTGTTAGAA GCTTGGCCGCCATGGCC CAACTTGTTTATTGCAGC TTATAATGGTTACAAATA AA (SEQ ID NO: 3268) | TAGATCAGGAGCTTAGGGG CTTTCCCTGGTTTCTGCTGAT ACCAATTTAAATAGTTGCTA ATGTCCTGACTCGCCTGGCA AGTGATGGTGACTCTGTCTC CTACAGATGCAGACAGGGN G (SEQ ID NO: 3269) | |
| COV21_P1 F9 | A-C005 | TACACATACGATTTAGGT ACACTATAGAATAACATCC ACTTTGCCTTTCCTTCCACA GGTGTCCACTCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG | NGAGGTGCTCTTGGAGGAG GGTGCCAGGGGGAAGACCG ATGGGCCCTTGGTGGAGGC TGAAGAGACGGTGACCATT GTCCCTTGGCCCCAGATATC AAAAGCATCAAGGGAGCTA CCACCGCTACAGTAATGGGAG CCGCACGGTAATACACGGC CGTGTCCTCCGGATCTCAGG | COV21_P1 F9 | TACACATACGATTAGGT GACACTATAGAATAACA TCCACTTTGCCTTCCT CCACAGGTCCCACTCCC AGTTCAACTGCACCTC GGTTCTATCGATTGAATT CCACATGGGATGGTCA TGTATCATCCTTTTCTA GTAGCAACTGCAACCGG | ANTTACCCGATTGGAGGGC GTTATCCACCTTCCACTGTA CTTTGGCCTCTCTGGGATAG AAGTTATTCAGCAGGCACAC AACAGAGCAGTTCCAGAT TTCAACTGCTCATCAGATGG CGGAAGATGAAGACAGAT TGTATCATCCTTTTTCTA GGTGCAGCCACAGTTCTTT GATTTCCACCTTGTCCCTT | COV21_P1 F9 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | CAGTCTGGTGCAGTCTGGGC CTGAGGTGAAGAAGCCTGG GACCTCAGTGAAGGTCTCC TGCAAGGCTTCTGGATTCA CCTTTACTAGCTCTGTGTG CAGTGGGTGCGACAGGCTC GTGGACAAGCCTTGAGTG GATAGGATGGTAACACAAACT GGCAGTGGTAACACAAACT ACGCACAGAAGTTCCAGGA AAGAGTCACCATTACCAGG GACATGTCCACAAGCACAG CCTACATGGAGCTGAGCAG GCCGTGTATTACTGTGCGG CTCCCCATTGTAGCGTGGT AGCTGCCTTGATGCTTTGA TATCTGGGCCAAGGGACA ATGGTCACCGTCTCTTCAGC GTCGACCAAGGGCCCATCG GTCTTCCCCCTGGCACCCTC CTCCAAGAGCACCTCTGGG GGCACAGCGGCCCTGGGCT GCCTGGTCAAGGACTACTT CCCCGAACCTGTGACGGTC TCGTGGAACTCANGCGCCC TGACCAGCGGCGTGCACAC CTTCCCGGCTGTCCTACAGT CCTCNNNCTCTACTCCCTCA GCAGCGTGGNGACCGTGCC CTCCAGCAGCTTGGGCACC CAGACCTACATCTGCAACG TGAATCACAAGCCCAGCAA CACCA (SEQ ID NO: 3270) | CTGCTCAGCTCCATGTAGG CTGTGCTTGTGGACATGTCC CTGGTAATGTGACTCTTTC CTGGAACTTCTGTGCGTAGT TTGTGTTACCACTGCCAACG ACGATCCATCCTATCCACTC AAGGCGTTGCTCCACAGCC TGTCCACCCACTGCACAG CAGAGCTAGTAAAGTGAA TCCAGAAGCCTTGCAGGAG ACCTTCACCTGAGGTCCCAG GCTTCTTCACCTCAGGCCCA GACTGCCACCAGCTGCACCT (SEQ ID NO: 3271) | | TGTACATTCAGAAATTGT GTTGACGCAGTCTCCAG GCACCCTGTCTTGTCTC CAGGGAAAGAGCCACC CTCTCCTGCAGGGCCAGT CAGAGTGTTAGAAGCAG CTACTAGCCTGGTACCA GCAAAACCTGGCCAGG CTCCCAGGCTCCTCATCT ATGGTGCATCCAGCAGG GCCACTGGCATCCCAGA CAGGTTCAGTGGCAGTG GGTCTGGGACAGACTTC ACTCTCACCATCAGCAG ACTGGAGCCTGAAGATT TTGCAGTGTATTACTGTC AGCAGTATGGTAGCTCA CCGTGGACCGTTCGGCCA AGGGACCAAGGTGGAAA TCAAACGTACGGTGCT GCACCATCTGTCTTCATC TTCCGCCATCTGATGAG CAGTTGAAATCTGGAAC TGCCTCTGTTGTGTGCCT GCTGAATAACTTCTATCC CAGAGAGGCCAAAGTAC AGTGGAAGGTGGATAAC GCCCTCCAATCGGGTAA CTCCCAGGAGAGTGTCA CAGAGCNNACAGCAAGG ACAGCACCTACAGCCTC AGCAGCACCCTGACGCT GAGCAAAGCAGACTACG AGAAACACAAAGTCTAC GCCTGCGAAGTCACCCA TC (SEQ ID NO: 3272) | GCCGAACGTCCACGGTGA GCTACCATACTGCTGACAGT AATACACTGCAAAATCTTCA GGCTCCAGTCTGCTGATGGT GAGAGTGAAGTCTGTCCCA GACCCACTGCCACTGAACCT GTCTGGGATGCCAGTGGCCC TGCTGGATGCACCATAGATG AGGAGCCTGGAGCCTGGC CAGGTTTCTGCTGGTACCAG GCTAAGTAGCTGCTTCTAAC ACTCTGACTGGCCCTGCAGG AGAGGGTGGCTCTTCCCCT GGAGACAAAGACAGGGAGA CTGGA (SEQ ID NO: 3273) | |
| COV21 P2 E5 | A-C006 | TACACATACGATTAGGTG ACACTATAGAATAACATCC ACTTTGCCTTTCTCCACA GGTGTCCACTCCCAGGTCC AACTGCACCTCGGTTCTATC GATTGAATTCCACCATGG ATGGTCATGTATCATCCTTT | GNNGCTGTNTNNNNNGAGGT GCTCTTGGAGGAGGGGTGCC AGGGGAAGACCGATGGGC CCTTGGTGGAGGCTGAGGA GACGGTGACCGTGGTCCCT TTGCCCCAGACGTTCCATGT AGTTGATTAGTAGATCGA | COV21 P2 E5 | TACACATACGATTTAGGT GACACTATAGAATAACA TCCACTTTGCCTTTCTCT CCACAGGTGTCCACTCCC CAGGTCTCAACTGCACCTC AGGTTCTAACTGCACCTC AGGTTCTAATCGATTGAATT GGTTCTATATCGATTGAATT CCACCATGGGATGGTCA | GNNAGCCTTGGGCTGACCTA NGACGGTCAGCTTGGTCCT CCGCCGAATACCGACCATT CAGGCTGTCATCCCATGCTG CAGAGAATAATCAGCCTC ATCCTCAGACTGGAGCCCAC TGATGGCCAGGGATGGCTGA | COV21 P2 E5 |

TABLE 15-continued

Additional sequence information for the disclosed anti-SARS-CoV-2 antibodies

| ALICE | AbsID | HEAVY CHAIN | | sequence ID (plate/well) | LIGHT CHAIN | | sequence ID (plate/well) |
|---|---|---|---|---|---|---|---|
| | | miniprep sequence | original nt sequence | | miniprep sequence | original nt sequence | |
| | | TTCTAGTAGCAACTGCAAC CGGTGTACATTCTCAGGTG CAGCTGGTGGAGTCTGGG GAGGCTTGGTCAAGCCTGG AGGGTCCCTGAGACTCTCC TGTGCAGCCTCTGGATTCAT CTTCAGTGACTACTGCATG AGCTGGATCCGCCGGGCTC CAGGGAAGGGGCTGGAATG GCTTTCATATATTAGTAATA GTGGTACCACCAGATACTA CGCAGACTCTGTGAAGGGC CGATTCACCATCTCCAGGG ACAACGGCCAGGAACTCACT GTATCTGCAAATGGACAGC CTGAGCGCCGAAGACACGG CCGTTTATTACTGTGCGAGA AGGGGGACAGGTAGCAGCT CGATCTACTACTACAACTA CATGGACGTCTGGGGCAAA GGGACCACGGTCACCGTCT CCTCAGCCTCCACCAAGGG CCCATCGGTCTTCCCCCTGG CACCCTCCTCCAAGAGCAC CTCTGGGGGCACAGCGGCC CTGGGCTGCCTGGTCAAGG ACTACTTCCCCGAACCTGTG ACGGTCTCGTGGAACTCAG CGGCCCTGACCAGCGGCGT GCACACCTTCCCGGCTGTCC TACAGTCCTCNNNCTCTACT CCCTCAGCAGCGTGTGAC CGTGCCCTCCAGCAGCTTG GGCACCCAGACCTACATCT GCAACGTGAATCACAAGCC CAGCAACACCAAGNGGACN AGANAGTTGAGCCCAAATC TTGTGANAAACTCACNCAT GCCCACCGTGCCCAG (SEQ ID NO: 3274) | GCTGCTACCGTCCCCCCTTC TCGCACAGTAATAAACGGC CGTGTCTTCGCGCTCAGG CTGTCCATTTGCAGATACA GTGAGTTCCTGCCGTTGTCC CTGGAGATGGTGAATCGGC CCTTCACAGAGTCTGCGTA GTATCTGGTCGTACCACTAT TACTAATATGAAAAGCCA TTCCAGCCCCTTCCCTGGAG CCCCGCGGATCCAGCTCAT GCAGTAGTCACTGAAGATG AATCCAGAGGCTGCACAGG AGAGTCTCAGGGACACCTC AGGCTTGACCAAGCCTCCC CCAGACTCCCACCAGCCTGC AC (SEQ ID NO: 3275) | | TGTATCATCCTTTTTCTA GTAGCAACTGCAACCGG TTCCTGGGCCAGTCTGT GCTGACTCAGCCACCCTC AGCGCTCTGGGACCCCCG GACAGAGGGTCACCGTC TCTTGTTCTGAAGCAGC TCCAACATCCGAAGCAA TACTGTAAACTGGTACC AGCAGCTCCCAGGAACG GCCCCAAACTCCATC TATAGTAATAATCAGCG GCCCTCAGGGGTCCCTG ACCGATTCTCTGGCTCCA AGTCTGGCACCTCAGCCT CCCTGGCCATCAGTGGG CTCCAGTCTGAGGATGA GGCTGATTATTTCTGTGC AGCAGGGATGACAGCC TGAATGGTCCGGTATTCG GCGGAGGGACCAAGCTG ACCGTCCTAGGTCAGCC CAAGGCTGCCCCCTCGG TCACTCTGTTCCCACCCT CGAGTGAGGAGCTTCAA GCCAACAAGGCCACACT GGTGTGTCTCATAAGTG ACTTCTACCCGGGAGCC GTGACAGTGGCCTGAA GGCAGATAGCAGCCCCG TCAAGGCGGGAGTGAG GCAGTACAGCTGCCAG GAAGCTACAGCTGCCAG GTCACGCATGAAGGAG GACTGGGAGAAGACAG TGGCCCCTACAGAATGTT CATAGAAGCTTGGCGC CATGCCCAACTTGTTTA TTGCAGCTTATAATGGTT ACAAATAAAGCAA (SEQ ID NO: 3276) | GGTGCCAGACTGGAGCCA GAGAATCGGTCAGGGACCC CTGAGGGCCGCGCTGATTATTA CTATAGATGAGGAGTTTGGG GGCCGTTCCTGGGAGCTGCT GGTACCAGTTTACAGTATTG CTTCGATGTTGGAGCTGCT TCCAGAACAAGAGACGGTG ACCCTCTGTCCGGGGTCCC AGACGCTGAGGGTGGCTGA GTCAGCACAGACTGGGCCC NGGAACCGTTGCNNNTNN CTTACTAGA (SEQ ID NO: 3277) | |

349
350

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | original nt sequence | sequence ID (plate/well) |
| COV21_P3 B5 | A-C009 | TACACATACGATTTAGGTG ACACTATAGAATAACATCC ACTTTGCCTTTCTCTCCACA GGTGTCCACTTCCCAGGTCC AACTGCCACCTCGGTTCTATC GATTGAATTCCACCATGGG ATGGTCATGTATCATCCTTT TTCTAGTAGCAACTGCAAC CGGTGTACAATTCCCAGGTG CAGCTGGTGCAGTCTGGG CTGAGGTGAAGAAGCCTGG GGCCTCAGTGAAGGTCTCC TGCATGGCTTCTGGATACA CCTTCACCGGCTACTATATG CACTGGGTGCGACAGGCC CTGGACAAGGGCTTGAGTG GATGGGATGGATCAACCCT AACAGTGGTGGCACAAACT ATGCACAGAGTTTCAGG CAGGGTCACCATGACCAGG GACACGTCCATCAGCACAG CCTACATGGAGCTGAGCAG GCTGAGATCTGACGACACG GCCGTGTATTACTGTGCGA GAGACTCCCCATTTAGTGCT TTAGGGGCCTTCCAATGACT ACTGGGGCCAGGGAACCCT GGTCACCGTCTCCTCAGCGT CGACCAAGGGCCCATCGGT CTTCCCCCTGGCACCCTCCT CCAAGAGCACCTCTGGGG CACAGCGGCCCTGGGCTGC CTGGTCAAGGACTACTTCC CCGAACCTGTGACGGTGTC GTGGAACTCANGCGCCCTG ACCAGCGGCGTGCACACCT TCCCGGCTGTCCTACAGTCC TCNNACTCTACTCCCTCAGC AGCGTGGTGACCGTGCCCT CCAGCAGCTTGGGCACCCA GACCTACATCTGCAACGTG AATCACAAGCCCAGCAACA CCANNNGGANANAGAGTTG AGCCCAAATCTTGTGACAA | CAGAGGTGCTCTTGAGGA GGGTGCCAGGGGAAGACC GATGGGCCCTTGGTGGAGG CTGAGGAGACGGTGACCAG GGTTCCCTGCCCAGTAG TCATTGAGGCCCCTAAAG CACTAAATGGGGAGTCTCT CGCACAGTAATACACGGCC GTGTCGTCAGATCTTCAGCCT GCTCAGGTCCATGTAGGCT GTGCTGATGGACGTGTCCC TGGTCATGGTGACCCTGCC CTGAAACTTCTGTGCATAGT TTGTGCCACCACTGTTAGG GTTGATCCATCCCATCCACT CAAGCCCTTGTCCAGGGGC CTGTCGCACCCAGTGCATA TAGTAGCCGGTGAAGGTGT ATCCAGAAGCATGAGCCCC GACCTTCACTGAGGCCTCCAG GGCTTCTTCACCTCAGCCCC AGACTGCCACCAGCTGCACC TGNNANNGGACNCCC (SEQ ID NO: 3279) | COV21_P3 B5 | TTGGGCTGACCTAGGACGGT CAGCTTGTCCCTCCGCCGA ATACCACATTGTTGCTGCCT GCATCTGAGCTGCAGTAATA CTCAGCCTCATCCTCAGCCT GGAGCCCAGAGACGGTCAG GGAGGCCCGTGTTGCCAGACT TGGAGCCAGAGAAGCGATC AGGGACCCCTGAGGGCCGC TTACTGACCTCATAAATCAT GAGTTTGGGGGCTTTGCCTG GGTGCTGTTGGTACCAGGAG ACATAGTTATAACCACCAAC GTCACTGCTGGTTCCAGTGC AGAGATGGTGACTGACTG TCCAGAGACCCGGACGCG GAGGGAGGCTGAGTCAG (SEQ ID NO: 3281) | COV21_P3 B5 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AACTCACACATGCCNCCG TGCCCAGC (SEQ ID NO: 3278) | | | CACGGCATGAAGGGAGCA CCGTGGAGAAGACAGTG GCCCCTACAGAATGTTC ATAGAAGCTTGGCCGCC ATGGCCCAACTTGTTTAT TGCAGCTTATAATGGTTA CAAA (SEQ ID NO: 3280) | | |
| COV21_P2 C7 | A-C012 | TACACCATACGATTTAGGTG ACACTATAGAATAACATCC ACTTTGCCTTTCTCTCCACA GGTGTCCACTCCCAGGTCC GAGACGGTGACCAGGGTTC CCNGGCCCCAGTAGTCAAA GTACCCTTGACATAGCTG TTCTAGTAGCAACTGCCAA CCGGTGTACATTCCCAGGT GCAGCTGGTCCAGTCTGGG GCTGAGGTGAAGAAGCCTG GGGCCTCAGTGAAGGTCTC CTGCAAGGCTTCTGGATAC ACCTTCACCGGCTACTATAT GCACTGGGTGCACAGGCC CCTGGACAAGGGCTTGAGT GGATGGGATGGATCAACCC TAACAGTGGTGGCAGAAAC TATACAGAAGGTTCAAG GCAGGGTCACCATGACCAG GGACACGTCCATCAGCACA GCCTACATGGAGCTGAGCA GGCTGAGATCTGACGACAC GGCCGTATATTACTGTGCG AGAGATCTCGGATACAGCT ATGTCCAAGGGTACTTTGA CTACTGGGGCCAGGGAACC CTGGTCACCGTCTCCTCAGC GTCGACCAAGGGCCCATCG CTCTTCCCCCTGGCACCCTC CTCCAAGAGCACCTCTGGG GGCACAGCGGCCCTGGGCT GCCTGGTCAAGGACTACTT CCCCGAACCTGTGACGGTC TCGTGGAACTCAGGCGCCC TGACCAGCGGCGTGCACAC | GNNCCCTNNGNNNNNNNNN GTGCTNTTTGGANNNNGGTG CCAGGGGAAGACCCATGG GCCCTTGGTGGAGGCTGAG CCNGGCCCCAGTAGTCAAA GTACCCTTGACATAGCTG TATCCGAGATCTCTGCAC AGTAATATACCGGCCGTGTC GTCAGATCTCAGCCTGTCC AGCTCCATGTAGGCTGTGC TGATGGACGTGTCCCTGGT CATGGTGACCCTGCCCTGA ACCTTCACCGGCTACTATAT AACTTCTGTGTATAGTTTCT GCCACACTTTAGGGTTG ATCCATCCATCCACTCAA GCCCTTGTCCAGGGCCTG TCGCACCCAGTGCATATAG TAGCCGAAGGTTGAAG CAGAGAGCCTTGCAGGAGAC CTTCACTGAGGCCCCAGGC TTCTTCACCTCAGCCCCAGA CTGCACCAGCTGCACCTG (SEQ ID NO: 3283) | COV21_P2 C7 | TACACCATACGATTTAGGT GACACTATAGAATAACA TCCACTTTGCCTTTCTCT CCACAGGTGTCCACTCCC AGTCCAACTGCACCTC GGTTCTATCGATTGAATT CCACCATGGGATGGTCA TGTATCATCCTTTTCTA GTAGCAACTGCAACCGG TTCCTGGGCCCAGTCTGC CCTGACTCAGCCTGCCTC CGAGTCTGGGTCTCCTGG ACAGTCGATCACCATCTC CTGCACTGGAACCAGCA GTGATGTTGGAGTTAT AACCTTGTCTCCTGTAC CAACAGCACCCAGGCAA AGCCCCAAACTCATGA TTTATGAGGCAGTAAG CGGCCCCTCAGGGGTTTCT AATGCTTCTCTGGCTCC AAGTCTGGCAACACGGC CTCCCTGACAATCTCTGG GCTCCAGGCTGAGGACG AGGCTGATTATTACTGCT GCTCATATGCAGGTAGT AACACTTGGGTGTTCGG CGGAGGGACCAAGCTGA CCGTCCTAGGTCAGCCC AAGGCTGCCCCCTCGGT CACTCTGTTCCCACCCTC GAGTGAGGAGCTTCAAG CCAACAAGGCCACACTG GTGTGTCTCATAAGTGAC TTCTACCCGGGAGCCGT GACAGTGGCCTGAAGG | GNCAGCCTTGGGCTGACCTA GGAGGGCTCAGCTTGGTCCCT CCGCCGAACACCCAAGTGTT ACTACCTGCATATGAGCAGC AGTAATAATCAGCCTCGTCC TCAGCCTGGAGCCCAGAGA TTGTCAGGGAGGCCGTGTTG CCAGACTTGGAGCCAGAGA AGCGATTAGAAACCCTGA GGGCCGCTTACTGCCCTCAT AAATCATGAGTTTGGGGCT TTGCCTGGGTGCTGTTCGTA CCAGGAGACAAGTTATAA CTCCACCATCACTGCTGGT TCCAGTCGAGGAGATGGTG ATCGACTTGTCCAGGAGACCC AGACTCGGAGGCAGGCTGA GTCAACACCGTTGCNNNGN NNAACTAGA (SEQ ID NO: 3285) | COV21_P2 C7 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | CTTCCCGGCTGTCCTACAGT CCTCNNNCTCTACTCCCTCA GCAGCGTGGTGACCGTGCC CTCCAGCAGCTTGGGCACC CAGACCTACATCTGCAACG TGAATCACAAGCCCAGCAA CACCAAGGTGACAGA (SEQ ID NO: 3282) | | | CAGATAGCAGCCCCGTC AAGGCGGGAGTGGAGAC CACCACCCTCCAAAC AAAGCAACAACAAGTAC GCGGCCAGCAGCTACCT GAGCCTGACGCCTGAGC AGTGAAGTCCCACAGA AGCTACAGACTGCCAGGT CACGCATGAAGGAGCA CCGTGG (SEQ ID NO: 3284) | | |
| COV21_P1 B2 | A-C013 | TACACATACGATTAGGTG ACATTAGAATAACATCC ACTTTGCCTTTCTCTCCACA GGTGTCCACTCCCAGTCC AACTGCCACTCCGGTTCTATC GATTGAATTCCACCATGGG ATGGTCATGTATCATCCTTT TTCTAGTAGCAACTGCAAC CGGTGTACATTCCCAGGTG CAGCTGGTGCAGTCTGGG CTGAGGTGAAGAAGCCTGG GTCCTCGGTGAAGGTCTCCT GCGCGGTCCCCAGATCTCA GGCTGCTCCAGCTCCATGTA CTTGCAGCAGCTATGCTATCA GCTGGGTGCGACAGGCCCC TGGACAAGGCTTGTGAGTG GATGGGATCATCCCTA TCTTTGGTACAGCAAACTA CGCACAGAAGTTCCAGGGC AGAGTCACGATTACCGCAG ACGAATCCACGAGCACAGC CTATACATGGAGCTGAGCAGC CTGAGATCTGAGGACACGG CCGTGTATTACTGTGCGAA AGGGATAATCGACTACTTTAT TGTTAGTAGTACCAGCTGCT ATCTAGATGCGGTTAGGCA GGGGTACTACTACTAC TACATGGACGTCTGGGGCA AAGGGACCACGGTCACCGT CTCCTCAGCGTCGACCAAG GGCCCATCCGTCTTCCCCCT GGCACCCTCCTCCAAGAGC | GGNCGCNGTGCCCCAGAGG TGCTCTTGGAGGAGGGTGC CAGGGGGAAGACCGATGGG CCCTTGGTGAGGCTGAGG AGACGGTGACCGTGGTCCC TTTGCCCCAGACGTCCATGT AGTAGTAGTAGTACCC CTGCCTAACCGCATCTAGA TAGCAGCTGGTACTACTAC AATAAAGTAGTCGATTCCC TCTCGCACAGTAATACACG GCCGTGTCCTCAGATCTCA GGCTGCTCCAGCTCCATGTA GGCTGTGCTCTGTGGATTCGT CCGCGTAATCGTGACTCT GCCCTGGAACTTCTGTGCGT AGTTTGCTGTACCAAAGAT AGGATGATCCTCCCATC CACTCAAGCCCTTGTCCAG GGGCCTGTCATCCAGCCA GATAGCATAGCTGCTGAAG GTGCCTCAGAAGCCTTGC AGGAGACCTTCACCTCAG CCCCAGACTGCCACCTCAG GCACCT (SEQ ID NO: 3287) | COV21_P1 B2 | TACACATACGATTAGGT GACACTATAGAATAACA TCCACTTTGCCTTTCTCT NNNNGNGTCCACTCCC AGTTCCAACTGCACCTC GGTTCTATCGATTGAATT CCACCATGGGATGGTCA TGTATCATCCTTTTTCTA GTAGCAACTGCAACCGG TGTACATTCAGAAATTGT GTTGACACAGTCTCCAG CCACCCTGTCTTTGTCTC CAGGGGAAAGAGCCACC CTCTCCTGCAGGGCCAGT CAGAGTGTTAGCAGCTA CTTAGCCTGGTACCAAC AGAAACCTGGCCAGGCT CCCAGGCTCCTCATCTAT GATGCATCCAACAGGGC CACTGGCATCCCAGCCA GGTTCAGTGGCAGTGGG TCTGGGACAGACTTCACT CTCACCATCAGCAGCCT AGAGCCTGAAGATTTTG CAGTTTATTACTGTCAGC AGCGTAGCAACTGGCCC CTCACTTTCGGCGGAGG GACCAAGGTGGAGATCA AACGTACGGTGGCTGCA CCATCTGTCTTCATCTTC CCGCCATCTGATGAGCA GTTGAAATCTGGAACTG CCTCTGTTGTGTGCCTGC | CGATTGAGGGCGTTATCCA CCTTCCACTGTACTTTGGCC TCTCTGGGATAGAAGTTATT CAGCAGGCACACAACAGAG GCAGTTCCAGATTTCAACTG CTCATCAGATGCGGAAAG ATGAAGACAGATGGTCAG CCACAGTCGTTTGATCTCC ACCTTGGTCCCTCCCGCCGAA AGTGAGGGGCCAGTTGCTA CGCTGCTGACAGTAATAAAC TGCAAAATCTTCAGGCTCTA GGCTGCTGATGTGAGAGT GAAGTCTGTCCCAGACCCAC TGCCACTGAACCTGGCTGGG ATGCCTAACACTCTGACTG GCCCTGCAGGAGAGGGTGG CTCTTTCCCCTGGAGACAAA GACAGGG (SEQ ID NO: 3289) | COV21_P1 B2 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | ACCCTGGGGCACAGCGG CCCTGGGCTGCCTGGTCAA GGACTACTTCCCCGAACCT GTGACGGTCTCGTGGAACT CAGGCGCCCTGACCAGCGG CGTGCACACCTTCCCGGCT GTCCTACAGTCCTCAGGAC TCTACTCCCTCAGCAGCGTG GTGACCGTGCCCTCCAGCA GCTTGGGCACCCAGACCTA CATCTGCAACGTGAATCAC AAGCCCAGCAACACCAA (SEQ ID NO: 3286) | | | TGAATAACTTCTATCCCA GAGAGGCCAAAGTACAG TGGAAGGTGGATAACGC CCTCCAATCGGGTAACTC CCAGGAGAGTGTCACAG AGCNNACAGCAAGGACA GCACTACAGCCTCAGC AGCACCCTGACGCTGAN CAAAGCANNACTACGAGA AACACCAAAGTCTACGCC TGCGAAGTCACCCATCN NNNCTGAGCTCGCCCGT CACAAAGAGCTTCAACA GGGGGANANTGTTANAA GCTTGGCCGCCATGGCC CAACTTGTTNATTGCAGC TTANATGGTTA (SEQ ID NO: 3288) | |
| COV21_P3 H10 | A-C014 | TACACATACGATTTAGGTG ACACTATAGAATAACATCC ACTTTGCCTTTCCTTTCCACA GGTGTCCAACTCCCAGGTCC CGCCTCAGCTGCGCGGCGT CCGGCTTCAATTTTTCCACT CACTGGATGCATTGGGTCA GATTGAATTCCACCATGGG GGCAAGCACCGGGAAAGG GCCTCGTGTGGGTATCTCG GATTAACTCGACAGTGCAGC AGAAGAGCTACGCTACCT CAGTGAAAGGAGGTTCAC GTGCTCATTGCGCCTCAG CTGCCGCGGCCTTCCGGCTTC AATTTTTCCACTCACTGGAT GCATTGGGTCAGGCAAGCA CCGGGAAAGGGCCTCGTGT GGGTATCTCGGATTAACTC CGATGCAGCAGAAGAGCC TACGCTACCTCAGTGAAAG GGAGGTTCACAATTTCACG GGATAACGCAAAAACACT CTCTATCTCCAGATGGACTC ACTCCGCGACGAAGATACA GCTGTCTATTACTGTACTAG GGATAGTTCTTGGCCG CATTTCTTCGACAACTGGG GTCAGGGGACCTTGGTGAC | GGGGCCACCGTGTGCACA GCAGTGGGGAGGCTTGGT GCAACCTGGTGGCTCATTG CGCCTCAGCTGCGCGGCGT CCGGCTTCAATTTTTCCACT CACTGGATGCATTGGGTCA GGCAAGCACCGGGAAAGG GCCTCGTGTGGGTATCTCG GATTAACTCGACAGTGCAGC AGAAGAGCTACGCTACCT CAGTGAAAGGAGGTTCAC AATTTCACGGGATAACGCA AAAACACTCTCTATCTCC AGATGGACTCACTCCGCGA CGAAGATACAGCTGTCTAT TACTGTACTAGGGATAGTA GTTCTTGGCCGCATTTCTTC GACAACTGGGGTCAGGGA CCTTGGTGACGGTCTCTAGC GCGTCGACGGCA (SEQ ID NO: 3291) | COV21_P3 H10 | TACACATACGATTTAGGT GACACTATAGAATAACA TCCACTTTGCCTTTCTCT CCACAGGTGTCCACTCCC AGGTCCAACTGCACCTC GGTTCTATCGATTGAATT CCACCATGGGATGGTCA TGTATCATCCTTTTTCTA GTAGCACTTGCAACCGG TTCCTGGGCCCAGTCTGT GCTGACTCAGCCTGCCTC CGTGCTCTGGGTCTCCTGG ACAGTCGATCACCATCTC CTGCACTGGAACCAGCA GTGACGTTGGTGTTATA ACTATGTCTCCTGGTACC AACAACCGGAGGCAAA GCCCCAAACTCATGATTC TATGATGTCAGTAATCG GCCTTCTCTGGCTCCAA TCGCTTTCTCTGGCTCCAA GTCTGGCAACACGGCCT CCCTGACCATCTCTGGGC TCCAGGCTGAGGACGAG GCTGATTATTACTGCAGC TCATATACAAGCAGCAG | CTTGGGCTGACCTAGGACGG TCAGCTTGGTCCTCCGCCG AATATCACATATCGAGAGTG CTGCTGCTTGTATATGAGCT GCAGTAATAATCAGCCTGT CCTCAGCCTGCGAGCCCAGA GATGGTCAGGGAGGCCGTG TTGCCAGACTTGGAGCCAGA GAAGCGATTAGAAACCCT GAGGGCCGATTACTGACATC ATAAATCATGAGTTTGGGGG CTTTGCCTGGGTGTGTTGG TACCAGGAGACATAGTTATA ACCACCAACGTCACTGCTGG TTCCAGTGCAGGAGATGGTG ATCGACTGTCCAGGAGACCC AGACACGGAGGCAGGCTGA GTCAGCACAGACTGGGNC AGGAACCGGNT (SEQ ID NO: 3293) | COV21_P3 H10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | GGTCTCTAGCGCGTGACC AAGGGCCCATCGGTCTTCC CCCTGGCACCCTCCTCCAA GAGCACCCTCTGGGGCACA GCGGCCCTGGGCTGCCTGG TCAAGGACTACTTCCCCGA ACCTGTGACGGTCTCGTGG AACTCAGGCGCCCTGACCA GCGGCGTGCACACCTTCCC GGCTGTCCTACAGTCCTCA GGACTCTACTCCCTCAGCA GCGTGGTGACCGTGCCCTC CAGCAGCTTGGGCACCCAG ACCTACATCTGCAACGTGA ATCACAAGCCCAGCAACAC CAAGGTGGACAAGAGAGTT GAGCCCAAATCTTGTGACA AAACTCACACATGCCCNNN CNNNGNGNCCAGCACCTGAA CTCCTGGGGGACCGTC (SEQ ID NO: 3290) | | | | | |
| COV21_P3 D12 | A-C015 | TACACATACGATTTAGGTG ACACTATAGAATAACATCC ACTTTGCCTTTCTCTCCACA GGTGTCCACTCCCAGGTCC AACTGCACCTCGGTTCTATC GATTGAATTCAACTGGGTAC ATGGTCATGTATCATCCTTT TTCTAGTAGCAACTGCAAC CGGTGTGCACAGCCGTCTGG AGGGGCTTGGTGAAACCT GGTGGTTCTCTTAGGCTGA GTTGCCTGCGTCAGGCTTT ACCTTTTCTTCTTTATAGCAT GAACTGGTACGCCAGAGG CCGGGCAAAGGTCTGAGT GGGTGTCCTCTATATCAAGT TCCAGTAGTACATTTACTA TGCTGTCAGTCAAAGGC AGATTACCACTGTTACAG | GGGGCCACCGGTGTGCACA GCGTCTGGAGGGGCTTGG TGAAACCTGGTGGTTCTCTT AGGCTGAGTTGCCTGCGT CAGGCTTTACCTTTTCTTCT TATAGCATGAACTGGGTAC GCCAAGCGCCGGGCAAAGG TCTGAGTGGGTGTCCTCTA TATCAAGTTCCAGTAGCTA CATTTACTATGCTGACTCAG TCAAAGGCAGATTTACCAT CAGCCGCGATAATGCCAAA AATTCACTCTATCTGCAAAT GAACTCTCTTCGCCAGAGG GATACCGCTGTCTACTACTG TGCTAGGGAGGTGAAAAGA ACTACTTTGATTATTGGGGT CAAGGGACACTTGTTACAG | COV21_P3 D12 | TACACATACGATTTAGGT GACACTATAGAATAACA TCCACTTTGCCTTTCTCT CCACAGGTGTCCACTCCC AGGTCTCCAACTGCACCTC GGTTCTATCCTCAGACTGAATT CCACCATGGGATGGTCA TGTATCATCCTTTTTCTA GTAGCAACTGCAACCGG TTCCTGAGGGCCGCCGATTA CTATTGTAAATGAGGAGTTT GGGGGCCGTTCCTTGGAGCT GCTGGAACCAGTTAACAGT TCTTGTTCTGGAATCAGC ATTACTTCCGAGGTTGAGC TGATTCAGAAACAAGAGAT GGTGACCCTTCTGTCCGGGG GCAGTCAGCACGCTGAGGGTGG CTGAGTCAGCACAGACTGG ACCAGGAACCGTTG (SEQ | COV21_P3 D12 |

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | miniprep sequence | original nt sequence | sequence ID (plate/well) |
| | A-C016 | ATAATGCCAAAAATTCACT CTATCTGCAAATGAACTCTC TTCGCGCAGAGGATACCGC TGTCTACTACTGTGCTAGGG AGGTGAAAGAGTAGTAGC TGCCCCAGAGTACTACTTTG ATTATTGGGTCAAGGGAC ACTTGTTACAGTCTCATCCG CGTGACCAAGGGCCATC GGTCTTCCCCCTGGCACCCT CCTCCAAGAGCACCTCTGG GGGCACAGCGGCCCTGGGC TGCCTGGTCAAGGACTACT TCCCCGAACCTGTGACGGT CTCGTGGAACTCAGGCGCC CTGACCAGCGGCGTGCACA CCTTCCCGGCTGTCCTACAG TCCTCAGGACTCTACTCCCT CAGCAGCGTGGTGACCGTG CCCTCCAGCTTGGGCA CCCAGACCTACATCTGCAA CGTGAATCACAAGCCCAGC AACACCAAGGTGGACAAGA GAGTTGAGCCCAAATCTTG TGACAAAACTCACACATGC CCACCGTGCCCAGCACC (SEQ ID NO: 3294) | TCTCATCCCGCTGCGACGGC A (SEQ ID NO: 3295) | | CCCTCAGGGGTCCCTGA CCGATTCTCTGGCTCCAA GTCTGGCACCTCAGCCTC CCTGGCCATCAGTGGGC TCCAGTCTGAGGATGAG GGTGACTATTACTGTGCA GAATGATGACAGCCT GAGTACTTGGGTGTTCG GTGGAGGGACCCACCTG ACCGTCCTACGTCAGCCC AAGGCTGCCCCTGGT CACTCTGTTCCCACCCTC GAGTGAGGAGCTTCAAG CCAACAAGGCCACACTG GTGTGTCTCATAAGTGAC TTCTACCCGGGAGCCGT GACAGTGCCCTGAAGG CAGATAGCAGCCCCGTC AAGGCGGAGTGGAGAC CACCACACCCTCCAAAC AAAGCAACAACAAGTAC GCGGCCAGCAGCTACCT GAGCCTGACGCCTGAGC AGTGGAAGTCCACAGA AGTACAGCTGCCAGGT CACGCATGAAGGGAGCA CCGTGGAGAAGACAGTG GCCCCTACAAGAATGTTC ATAGAAGCTTGGCCCGC ATGGCCCAACTTGTTTAT TGCAGCTTATAATGGTTA CAAA (SEQ ID NO: 3296) | ID NO: 3297) | |
| COV21_P3 A4 | | TACACATACGATTTAGGTG ACACTATAGAATAACA ACTTTGCCTTTCTCTCCACA GGTGTCCACTCCCAGGTCC AACTGCACCTCGGTTCTATC GATTGAATTCACCATGGG ATGGTCATGTATCACCCTTT TTCTAGTAGCAACTGCAAC CGGTGTACATTCTGAGGTG CAGCTGGTGGAGTCTGGGG AGGCGTTGGTCCAGCCTGG GAGGTCCCTGAGACTCTCC | GCTGTGNNNNAGAGGTGCT CTTGGAGGAGGGTGCCAGG GGGAAGACCGATGGGCCCT TGGTGGAGGCTGAGAGAC GGTGACCAGGGTTCCCTGG CCCCAGTAGTCAAAGTTAC CTCCGTAGCAGCTACCACC ACTACAATAAGGGGGGTC CAGCCGTGTCCTCAGCTCTC AGGCTGTTCATTTGCAGAT ACAGGCGTGTTCTTTGAATT | COV21_P3 A4 | TACACATACGATTTAGGT GACACTATAGAATAACA TCCACTTTGCCTTTCTCT CCACAGGTGTCCACTCC AGGTCCAACTGCACCTC GGTTCTATCGATTGAATT CCACCATGGAGACAGTCA TGTATCATCCTTTTTCTA GTAGCAACTGCAACCGG GTACATTGCCAACCCG TGTACATTGGCCATCCG GATGACCCAGTCTCCATC CTCCCTGTCTGCATCTGT | TNCCCGATTGGAGGGCGTTA TCCACCTTCCACTGTACTTT GGCCTCTCTGGGATAGAAGT TATTCAGCAGGCACACAAC AGAGGCAGTTCCAGATTTCA ACTGCTCATCAGATGGCGGG AAGATGAAGACAGATGGTG CAGCCACAGTTCGTTTGATC TCCACCTTGGTCCCTCCGCC GAAAGTAGGAGGGAGATTA TCATACTGTTGACAGTAATA TGTTGCAATATCTTCAGGCT | COV21_P3 A4 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | TGTGCAGCCTCTGGATTCAC CTTCAGTAGATATGGCATG CACTGGGTCCGCCAGCTC CAGGCAAGGGGCTGGAGTG GGTGGCAGTTATATCATAT GATGGAAGTAATAAATACT ATGCAGACTCCGTGAAGGG CCGATTCACCATCTCCAGA GACAATTCCAAGAACACGC TGTATCTGCAAATGAACAG CCTGAGAGCTGAGGACACG GCTGTGTATTACTGTGCGA AAGTGACCGCCCCTTATTGT AGTGGTGGTAGCTGCTACG GAGGTAACTTTGACTACTG GGGCCAGGGAACCCTGGTC ACCGTCTCCTCAGCGTCGA CCAAGGGCCCATCGGTCTT CCCCCTGGCACCCCTCCTCCA AGAGCACCTCTGGGGGCAC AGCGGCCCTGGGCTGCCTG GTCAAGGACTACTTCCCCG AACCTGTGACGGTCTCGTG GAACTCANGCCGCCCTGACC AGCGGCGTGCACACCTTCC CGGCTGTCCTACAGTCCTCN NACTCTACTCCCTCAGCAG CGTGTGACCGTGCCCTCC AGCAGCTTGGGCACCCAGA CCTACATCTGCAACGTGAA TCACAAGCCCAGCACACC A (SEQ ID NO: 3298) | GTCTCTGGAGATGGTGAAT CGGCCCTTCACGGAGTCTG CATAGTAATTATTACTTCCA TCATATGATAATAACTGCCA CCCACTCCAGCCCCCTTGCCT GGAGCCTGGCGGACCCAGT GCATGACCATATCTACTGAA GGTGAATCCAGAGGCTGCA CAGGAGAGTCTCAGGGACC TCCCCCAGGCTGACCACGCC TCCCCAGACTCCACCAGCC CTGCAC (SEQ ID NO: 3299) | | AGGAGACAGAGTCACCA TCACTTGCCAGGCCAGT CAGGACATTAGCAACTA TTTAAATTGGTATCAGCA GAAACCAGGGAAAGCCC CTAAGCTCCTGATCTACG ATGCATCCAATTTGGAA ACAGGGTCCCATCAAG GTTCAGCGGAAGTGGAT CTGGGACAGATTTTACTT TCACCATCAGCAGCCTG CAGCCTGAAGATATTGC AACATATTACTGTCAAC AGTATGATAATCTCCCTC CTACTTTCGGCGGAGGG ACCAAGGTGGAGATCAA ACGTACGGTGGCTGCAC CATCTGTCTTCATCTTCC CGCCATCTGATGAGCAG TTGAAATCTGAACTGC CTCTGTTGTGTGCCTGCT GAATAACTTCTATCCCAG AGAGGCCAAAGTACAGT GGAAGGTGATAACGCC CTCCAATCGGGTAACTCC CAGGAGAGTGTCACAGA GCAGGACAGCAAGGACA GCACCTACAGCCTCAGC AGCACCCTGACGCTGAG CAAAGCAGACTACGCC AACACAAAGTCTACGCC TGCGAAGTCACCCATCA GGGCCTGAGCTCGCCCG TCACAAAGAGCTTCAAC AGGGGAGAGTGTTAGAA GCTTGGCCGCCATGGCC CAACTTGTTTATTGCAGC TTATAATGG (SEQ ID NO: 3300) | GCAGGCTGTTGATGGTGAA AGTAAAATCTGTCCCAGATC CACTTCCGCTGAACCTTGAT GGGACCCCTGTTTCCAAATT GGATGCATCGTAGATCAGG AGCTTAGGGGCTTTCCCTGG TTTCTGCTGATACCCATTTA AATAGTTGCTAATGTCCTGA CTCGCCTGGCAAGTGATGGT GACTCTGTCTCCTACAGATG CAGACAGGNG (SEQ ID NO: 3301) | |
| COV21_P1 E10 | A-C017 | TACACATACGATTAGGTG ACACTATAGAATAACATCC ACTTTGCCTTTCTCCACA GGTGTCCACTCCCAGGTCC AACTGCACCTCGGTCTATC | GAGGTGCTCTTGGAGGAGG GTGCCAGGGGGAAGACCGA TGGGCCCTTGGTGGAGGCT GAGGAGAGCTGACCAGGG TTCCCTGGCCCCCAGTGGTCG | COV21_P1 E10 | TACACATACGATTAGGT GACACTATAGAATAACA TCCACTTTGCCTTTCTCT CCACAGGTGTCCACTCCC AGGTCCAACTGCACCTC | CCGATTGAGGGCGTTATCC ACCTTCCACTGTACTTTGGC CTCTCTGGGATAGAAGTTAT TCAGCAGGCACACAACAGA GGCAGTTCCAGATTTCAACT | COV21_P1 E10 |

TABLE 15-continued

Additional sequence information for the disclosed anti-SARS-CoV-2 antibodies

| ALICE AbsID | HEAVY CHAIN | | LIGHT CHAIN | |
|---|---|---|---|---|
| | miniprep sequence | original nt sequence | sequence ID (plate/well) | miniprep sequence | original nt sequence | sequence ID (plate/well) |
| | GATTGAATTCCACCATGGG<br>ATGGTCATGTATCATCCTTT<br>TTCTAGTAGCAACTGCAAC<br>CGGTGTACATTCTGAAGTG<br>CAGCTGGTGGAGTCTGGGG<br>GAGGCTTGGTACAGCCTGG<br>CAGGTCCCTGAGACTCTCCT<br>GTGCAGCCTCTGGATTCAC<br>CTTTGATGATTATGCCATGC<br>ACTGGGTCCGGCAAGCTCC<br>AGGGAAGGGCCTGGAGTGG<br>GTCCTCAGGTATTAGTTGGA<br>ATAGTGGTACCATAGGCTA<br>TGCCGACTCTGTGAAGGGC<br>CGATTCACCATCTCCAGAG<br>ACAACGCCAAGAACTCCCT<br>GTATCTGCAAATGAACAGT<br>CCTTTTATTACTGTGCAAAA<br>GCGGGCGTAAGGGGTATAG<br>CAGCAGCTGGTCCCGACCT<br>CAACTTCGACCACTGGGGC<br>CAGGGAACCCTGGTCACCG<br>TCTCCTCAGCGTCGACCAA<br>GGGCCCATCGGTCTTCCCC<br>TGGCACCCTCCTCCAAGAG<br>CACCTCTGGGGGCACAGCG<br>GCCCTGGGCTGCCTGGTCA<br>AGGACTACTTCCCCGAACC<br>TGTGACGGTCTCGTGGAAC<br>TCAGGCGCCCTGACCAGCG<br>GCGTGCACACCTTCCCGGC<br>TGTCCTACAGTCCTCAGGA<br>CTCTACTCCCTCAGCAGCGT<br>GGTGACCGTGCCCTCCAGC<br>AGCTTGGGCACCCAGACCT<br>ACATCTGCAACGTGAATCA<br>CAAGCCCAGCACCAA<br>(SEQ ID NO: 3302) | AAGTTGAGGTCGGGACCAG<br>CTGCTGCTATACCCCTTACG<br>CCCGCTTTTGCACAGTAATA<br>AAAGGCCGTGTCCTCAGCT<br>CTCAGACTGTTCATTTGCAG<br>ATACAGGGAGTTCTTGGCG<br>TTGTCTCTGAGATGGTGA<br>ATCGGCCCTTCACAGAGTC<br>CGCATAGCCTATGTACCA<br>CTATTCCAACTAATACCTGA<br>GACCCACTCCAGGCCCTTC<br>CCTGGAGCTTGCCGACCG<br>AGTGCATGGCATAATCATC<br>AAAGTGAATCCAGAGGCT<br>GCACAGGAGAGTCTCAGGG<br>ACCTGCCAGGCTGTACCAA<br>GCCTCCCCAGACTCCACN<br>NNNTTGCAC (SEQ ID NO: 3303) | | GGTTCTATCGATTGAATT<br>CCACCATGGGGATGGTCA<br>TGTATCATCCTTTTTCTA<br>GTAGCAACTGCAACCGG<br>TGTACATTCAGAAATTGT<br>GTTGACACAGTCTCCAG<br>CCACCCTGTCTTTGTCTC<br>CAGGGGAAAGAGCCACC<br>CTCTCCTGCAGGGCCAGT<br>CAGAGTGTTAGCAGCTA<br>CTTAGCCTGGTACCAAC<br>AGAAACCTGGCCAGGCT<br>CCCAGGCTCCTCATCTAT<br>GATGCATCCAACAGGGC<br>CACTGGCATCCCAGCCA<br>GGTTCAGTGGCAGTGGG<br>TCTGGGACAGACTTCACT<br>CTCACCATCAGCAGCCT<br>AGAGCCTGAAGATTTG<br>CAGTTTATTACTGTCAGC<br>AGCGTATCACCTTCGGCC<br>AAGGGACACGACTGGAG<br>ATTAAACGTACGGTGGC<br>TGCACCATCTGTCTTCAT<br>CTTCCCGCCATCTGATGA<br>GCAGTTGAAATCTGGAA<br>CTGCCTCTGTTGTGTGCC<br>TGCTGAATAACTTCTATC<br>CCAGAGAGGCCAAAGTA<br>CAGTGGAAGGTGGATAA<br>CGCCCTCCAATCGGGTA<br>ACTCCCAGGAGAGTGTC<br>ACAGAGCAGGACAGCAA<br>GGACAGCACCTACAGCC<br>TCAGCAGCACCCTGACG<br>CTGAGCAAAGCAGACTA<br>CGAGAAACACAAAGTCT<br>ACGCCTGCGAAGTCACC<br>CATCNGGCCTGAGCTCG<br>CCCGTCACAAAGAGCTT<br>CAACAGGGAGAGTGTT<br>AGAAGCTTGGNCGCCAT<br>GGCCCAACTTGTTTATTG | GCTCATCAGATGGCGGGAA<br>GATGAAGACAGATGGTGCA<br>GCCACAGTTCGTTAATCTC<br>CAGTCGTGTCCCTTGGCCGA<br>AGTGATACGCTGCTGACA<br>GTAATAAACTGCAAAATCTT<br>CAGGCTCTAGGCTGCTGATG<br>GTGAGAGTGAAGTCTGTCCC<br>AGACCCACTGCCACTGAACC<br>TGGCTGGGATGCCAGTGGCC<br>CTGTTGGATGCATCATAGAT<br>GAGGAGCCTGGGAGCCTGG<br>CCAGGTTTCTGTTGGTACCA<br>GGCTAAGTAGCTGCTAACAC<br>TCTGACTGGCCCTGCAGGAG<br>AGGGTGGCTCTTTCCCCTGG<br>AGACAAAGACAGGAGACT<br>GGA (SEQ ID NO: 3305) | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| COV21_P3 E2 | A-C028 | TACACCATACGATTTAGGTG ACACTATAGAATAACATCC ACTTTGCCTTTCTCTCCACA GGTGTCCACTCCCAGGTCC AACTGCACCTCGGTTCTATC GATTGAATTCCACAAGTGAG ATGGTCATGTATCATCCTTT TTCTAGTAGCAACTGCAAC CGGTGTACTTCTGAAGTGC AGCTGTGGAGTCTGGGGG AGGCTTGGTACAGCCTGGC AGTCCCTGAGACTCTCCT GTGCAGCCTCTGGATTCAC CTTTGATGATTATGCCATGC ACTGGGTCCGGCAAGCTCC AGGGAAGGGCCTGAGTGG GTCTCAGGTATTAGTTGGA ATAGTGGTAGCATAGGCTA TGCCGACTCTGTGAAGGG CGATTCACCATCTCCAGAG ACAACGCCAAGAACTCCCT GTATCTGCAAATGAACAGT CTGAGAGCTGAGGACACGG CCTTGTATTACTGTGCAAAA GCGGGCGTAAGGGGTATAG CAGCAGCTGGTCCCGACCT CAACTTTGACTACTGGGGC CAGGGAACCCTGGTCACCG TCTCCTCAGCGTCGACCAA GGGCCATCCGGTCTTCCCC TGGCACCCTCCTCCAAGAG CACCCTCTGGGGCACAGCG GCCCTGGGCTGCCTGGTCA AGGACTACTTCCCCGAACC TGTGACGGTCTCGTGGAAC TCAGGCGCCCTGACCAGCG GCGTGCACACCTTCCCGGC GCTGTCCACAGTCCTCAGGA CTCTACTCCCTCAGCAGCGT GGTGACCGTGCCCTCCAGC CTGTGCCCCAGAGGTGCTC TTGGAGGAGGTGCCAGGG GGAAGACCGATGGGCCCT GGTGAGGGCTGAGGAGACG GTGACCAGGGTTCCCTGGC CCCAGTAGTCAAAGTGAG GTCGGGACCAGCTGCTGCT ATACCCCTTACGCCCGCTTT TGCACAGTAATACAAGGCC GTGTCCTCAGCTCTCAGACT GTTCATTTGCAGATACAGG GAGTTCTTGGCGTTGTCTCT GGAGATGGTGAATCGGCCC TTCACAGAGTCCGCATAGC CTATGCTACCACTATTCCAA CTAATACCTGAGACCCACT CCAGCCCTTCCCTGGAGC TTGCCGACCCAGTGCATG GCATAATCATCAAGGTGA ATCCAGAGGCTGCACAGGA GAGTCTCAGGGACCTGCCA GGCTGTACCAAGCCTCCCC CAGACTCCACCAGCTGCAC (SEQ ID NO: 3307) | COV21_P3 E2 | TACACATACGATTTAGGTT GACATATAGAATAACA TCCACTTTGCCTTTCTCT CCACAGGTGTCCACTCCC AGTTCCAACTGCACCTC GGTTCTCATCAGATGCGGG CCACCATGGGATGGTCA TGTATCATCCTTTTTCTA GTAGCAACTGCAACCGG TGTACTTCAGAAATTGT GTTGACACAGTCTCCAG CCACCCTGTCTTTGTCTC CAGGGGAAAGAGCCACC CTCTCCTGCAGGGCCAGT CAGAGTGTTAGCAGCTA CTTAGCCTGGTACCAAC AGAAACCTGGCCAGGCT CCCAGGCTCCTCATCTAT GATGCATCCAACAGGGCC ACTGGCATCCCAGCCA GGTTCAGTGCAGTTCACT TCTGGGACAGACTTCACT CTCACCATCAGCAGCCT AGAGCCTGAAGATTTTG CAGTTTATTACTGTCAGC AGCGTATCACCTTTCGGCC AAGGGACACGACTGGAG ATTAAACGTACGTGGC TGCACCATCTGTCTTCAT CTTCCCGCCATCTGATGA GCAGTTGAAATCTGAA CTGCCTCTGTTGTGTGCC TGCTGAATAACTTCTATC CCAGAGAGGCCAAAGTA CAGTGGAAGGTGGATAA CGCCCTCCAATCGGGTA ACTCCCAGGAGAGTGTC ACAGAGCAGGACAGCAA GGACAGCACCTACAGCC TCAGCAGCACCCTGACG | TACCCGATTGGAGGGCGTTA TCCACCTTCCACTGTACTTT GGCCCTCTGGGATAGAAGT TATTCAGCAGGCACACAAC AGAGGCAGTTCCAGATTTCA ACTGCTCATCAGATGCGGG AAGATGAAGACAGATGGTG CAGCCACAGTTCGTTTAATC TCCAGTCGTGTCCCTTGCC GAAGGTGATACGCTGCTGA CAGTAATAAACTGCAAAT CTTCAGCTCTAGGCTGCTG ATGGTGAGAGTGAAGTCTGT CCCAGACCCACTGCCACTGA ACTGGCGTGGGATGCCAGTG GCCCTGTTGGATGCATCATA GATGAGGAGCCTGGAGCC TGGCCAGGTTTCTGTTGGTA CAGGCTAAGTAGCTGCTAA CACTCTGACTGGCCCTGCAG GAGAGGGTGGCTCTTTTCCC TGGAGACAAAGACAGGNG ACTGNNNNGGGGGTCATA CCAATCTCGCANGT (SEQ ID NO: 3309) | COV21_P3 E2 |
| | | | CAGCTTATNATGGNTAC AAATAAAGCAATAGCAT CACAAATTTCAC (SEQ ID NO: 3304) | | | | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AGCTTGGGCACCCAGACCT ACATCTGCAACGTGAATCA CAAGCCCAGCAACACCAAN GTGGACAAGAGAGTTGAGC CCAAATCTTGTGACAAAAC TCACACATGCCCACCGTGC CC (SEQ ID NO: 3306) | | | CTGAGCAAAGCCANACTA CGAGAAACACCAAAGTCT ACGCCTGCGAAGTCACC CATCNGNCCTGAGCTCG CCCGTCACAAAGAGCTT CAACAGGGAGAGTGTT AGAAGCTTGCCCGCCAT GGNNCAACTTGTTTATTG CAGCTTATAATGGTTACA AATAAAGCAATAGCATC (SEQ ID NO: 3308) | |
| COV21_P3 B9 | A-C018 | TACACATACGATTAGGTG ACATTATAGAATAACATCC ACTTTGCCTTTCTCTCCACA GGTGTCCACTCCCAGGTCC AACTGCCACCTCGGTTCTATC GATTGAATTCCACCATGGG ATGGTCATGTATCATCCTTT TTCTAGTAGCAACTGCAAC CGGTGTACATTCTGAGGTG CAGCTGGTGGAGTCTGGG GAGGCTGTCCAGCCTGG GAGGTCCTCAGACTCTCC TGTGCAGCCTCTGGATTCAC CTTCAGTAACTATGCTATAC ACTGGGTCCGCCAGGCTCC AGGCAAGGGCTGGAGTGG GTGGCAGTTATATCATATG ATGGAAGCAATAAATACTA CGCAGACTCCGTGAAGGGC CGATTCACCATCTCCAGAG ACAATTCCAAGAACACGCT GTATCTGCAAATGAACAGC CTGAGAGCTGAGGACACGG CTGTGTATTACTGTGCCGAG AGATTTGACGATAGTTCGT TCTGGCGTTTGACTACTGG TCTGCCTCTCAGCCTCGAC CGTCTCCAGGGAACCCTGGTCA CCGTCTCCTCAGCGTCGACC AAGGGCCCATCGGTCTTCC CCCTGGCACCCTCCTCCAA GCGCCCTGGGCCTGCTGG TCAAGGACTACTTCCCCGA | GCTGTGNNNNNGAGTGCT CTTGGAGGAGGTGCCAGG GGGAAGACCGATGGGCCT TGGTGGAGGCTGAGAGAC GGTGACCAGGGTTCCCTGG CCCAGTAGTCAAACGCCC AGAACGAACTATCGTCAAA ATCTCTGCACAGTAATAC ACAGCCGTGTCCTCCAGCTCT CAGGTCGTTCATTTTGCAGAT ACAGGCGTGTTCTTGGAATT GTCTTGGAGATGGTGAAT CGGCCCTTCACGGAGTCTG CGTAGTAATTATTGCTTCCA TCATATGATATAACTGCCA CCCCATCCAGTGTCCCTGCCT GGAGCCTGGCGGACCCAGT GTATAGCATAGTTACTGAA GGTGAATCCAGAGGCTGCA CAGGAGGTCTCAGGGACC TCCCAGGCTGGACCACACGG TCCCCCAGACTCCACCAGN CCTGCAC (SEQ ID NO: 3311) | COV21_P3 B9 | TACACATACGATTTAGGT GACACTATAGAATAACA TCCACTTTGCCTTTCTCT CCACAGGTGTCCACTCCC AGTTCCAACTGCACCTC GGTTCTATCGATTGAATT CCACCATGGAGATGTCA TGTATCATCCTTTTTCTA GTAGCAACTGCAACCGG TGTACATTCAGACATCCA GTTGACCCAGTCTCCATC CTCCCTGTCTGCGTCTGT AGGAGACAGAGTCACCA TCACTTGCCGGGCAAGT CAGAGCATTCGAGCTA TTTAAATTGGTATCAACA GAAACCAGGGAAAGCCC CTAAGCTCCTGATCTATG CTGCATCCAGTTTGCAAA GTGGGGTCCCTTCAAG TTCAGTGGCAGTGGATCT GGGACAGATTTCACTCTC ACCATCAGCAGTCTGCA ACCTGATGATTTTGCAAC TTACTACTGTCAACAGA GTTACAGTACCCCTCCGG CACTTTTGGCCAGGGG ACCAAGCTGGAGATCAA ACGTACGGTGGCTGCAC CATCTGTCTTCATCTTCC CGCCATCTGATGAGCAG TTGAAATCTGGAACTGC CTCGTTGTGTGCCTGCT | GNNNNTNCNNGATTGGAGG GCGTTATCCACCTTCCACTG TACTTTGGCCTCTCTGGGAT AGAAGTTATTCAGCAGGCA CACAACAGAGGCAGTTCCA GATTTCAACTGCTCATCAGA TGGCGGAAGATGAAGACA GATGGTGCAGCCACAGTTCG TTTGATCTCCAGTTGGTCC CCTGGCCAAAAGTGGCCGG AGGGGTACTGTAACTCTGTT GACAGTAAGTTGCAAA ATCATCAGGTTGCAGACTGC TGATGGTGAGAGTGAAATCT GTCCAGATCCACTGCCACT GAACCTTGAAGGGACCCCA CTTTGCAAACTGGATGCAGC ATAGATCAGGAGCTTAGGG GCTTTCCCTGGTTTCTGTTG ATACCAATTTAATAGCTGC GAATGCTCTGACTTGCCCGG CAAGTGATGGTGACTCTGTC TCCTACAGCAGACGAGACAGG GNGG (SEQ ID NO: 3313) | COV21_P3 B9 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | ACCTGTGACGGTCTCGTGG AACTTCAGGGCCCTGACCA GCGGCGTGCACACCTTCCC GGCTGTCCTACAGTCCTCA GGACTCTACTCCCTCAGCA GCGTGGTGACCGTGCCCTC CAGCAGCTTGGGCACCCAG ACCTACATCTGCAACGTGA ATCACAAGCCCAGCAACAC CAANGTGGACAAGAGAGTT GAGCCCAAATCTTGTGACA AAACTCACACATGCCCACC GTGCCCAGCACCT (SEQ ID NO: 3310) | | | GAATAACTTCTATCCCAG AGAGGCCAAAGTACAGT GGAAGGTGGATAACGCC CTCCAATCGGGTAACTCC CAGGAGAGTGTCACAGA GCAGGACAGCAAGGACA GCACCTACAGCCTCAGC AGCACCCTGACGCTGAG CAAAGCAGACTACGCC AACACAAAGTCTACGC TGCGAAGTCACCCATCA GGGCCTGAGCTCGCCCG TCACAAAGAGCTTCAAC AGGGGAGAGTTAGAA GCTTGGCCGCCATGGCC CAACTTGTTTATTGCAGC TTATAATGTTACAAA (SEQ ID NO: 3312) | |
| COV21_P1 G8 | A-C019 | TACACATACGATTTAGGT ACACTATAGAATAACATCC ACTTTGCCTTTCTCTCCACA GGTGTCCACTCCCCAGGTCC AACTGCACCTGGGTTCTATC GATTGAATTCCACCATGGG ATGGTCATGTATCATCCTTT TTCTAGTAGCAACTGCAAC CGGTGTACATTCCCAGGTG CAGCTGGTGCAGTCTGGG CTGAGGTGAAGAAGCCTGG GGCCTCAGTGAAGGTTTCC TGCAAGGCACGTTGGATACA CCTTCACCAGTTACTATATG CACTGGGTGCGACAGGCCC CTGGACAAGGGCTTGAGTG GATGGGAATAATCAACCCT AGTGGTGGTAGCACAAGCT ACGCACAGAAGTTCCAGG GCAGAGTCACCATGACCAGG GACAGCTCCACGAGCACAG TCTACATGGAGCTGAGCAG CCTGAGATCTGAGGACACG GCCGTGTATTACTGTGCTAG AGTGCCCCGTGAGGGACC CCAGGGTTCGACCCCTGGG | | COV21_P1 G8 | TACACATACGATTTAGGT GACACTATAGAATAACA TCCACTTTGCCTTTCTCT CCACAGGTGTCCACTCCC AGGTCAACTGCACCTC GGTTCTATCGATTGAATT CCACCATGGGATGGTCA TGTATCATCCTTTTTCTA GTAGCAACTGCAACCGG TTCTGTGACCTCCTATGA GCTGACACAGCCACCCT CAGTGTCAGTGGCCCCA GGAAAGACCCTCCAGAT TACCTGTGGGGAAAACA ACATTGGAAGTAAAAGT GTGCACTGGTACCAGCA GAAGCCAGGCCAGGCC CTGTCTGGTCATCTATT ATGATAGCCACCGGCCC TCAGGGATCCCTGAGCG ATTCTCTGGCTCCAACTC TGGGAACACGGCCACCC TGACCATCAACAGGGTC GAAGCCGGGGATGAGGC CGACTATTACTGTCAGGT GTGGGATAGTAGTGTG | AGGGGGCCANCTTGGGCTG ACCTAGGACGGTCAGCTTGG TCCCTCCGCCGAATACCACA TGATCACTACTACTATCCCA CACCTGACGTAATAGTCGG CCTCATCCCGGCTTCGACC CTGTTGATGGTCAGGGTGGC CGTGTTCCCAGAGTTGGAGC CAGAGAATCGCTCAGGGAT CCCTGAGGGCCGGTCGCTAT CATAATAGATGACCAGCAC AGGGGCTGGCCTGGCTTCT GCTGTACCAGTGCACACTT TTACTTCCAATGTTGTTTTCC CCACAGGTAATCCTGGCCGT CTTTCCTGGGGCCACTGACA CTGAGGGTGGCGTGAGTCAG CACAGACTGGGCCCAGGAA CCGGTTGCAGNNNNNTACT AAAANG (SEQ ID NO: 3317) | COV21_P1 G8 |

371 372

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | GCCAGGGAACCCTGGTCAC<br>CGTCTCCTCAGCGTCGACC<br>AAGGGCCCATCGGTCTTCC<br>CCCTGGCACCCTCCTCCAA<br>GAGCACCTCTGGGGGCACA<br>GCGGCCCTGGGCTGCCTGG<br>TCAAGGACTACTTCCCCGA<br>ACCTGTGACCGTCTCGTGG<br>AACTCAGGCGCCCTGACCA<br>GCGGCGTGCACACCTTCCC<br>GGCTGTCCTACAGTCCTCA<br>NGACTTCCCTCAGCA<br>GCGTGGTGACCGTGCCCTC<br>ACCTACATCTGCAACGTGA<br>ATCACAAGCCCAGCAACAC<br>C (SEQ ID NO: 3314) | | | ATCATGTGGTATTCGGCG<br>GAGGGACCAAGCTGACC<br>GTCCTAGGTCAGCCCAA<br>GGCTGCCCCCTCGGTCAC<br>TCTGTTCCCACCCTCGAG<br>TGAGGAGCTTCAAGCCA<br>ACAAGGCCACACTGTG<br>TGTCTCATAAGTGACTTC<br>TACCCGGAGCCGTGAC<br>AGTGGCCTGAAGGCAG<br>ATAGCAGCCCGTCAAG<br>GCGGGAGTGGAGACCAC<br>CACACCCTCCAAACAAA<br>GCAACAACAAGTACGCG<br>GCCAGCAGTACCTGAAG<br>CCTGACGCCTGAGCAGT<br>GGAAGTGCCAGGTCAC<br>GCATGAAAGGGAGCAC<br>GTGGANAAGACAGTGGC<br>CCCTACAGAATGTTCATA<br>GAAGCTTGGCCGCCATG<br>GCCCAACTTGTTTATGC<br>AGCTTATAATGG (SEQ<br>ID NO: 3316) | | |
| COV21_P3<br>G5 | A-C020 | TACACATACGATTTAGGTG<br>ACACTATAGAATAACATCC<br>ACTTTGCCTTTCTCTCCACA<br>GGTGTCCACTCCCAGGTCC<br>AACTGCACCTCGGTTCTATC<br>GATTGAATTCACCATGGG<br>ATGGTCATGTATCATCCTTT<br>TTCTAGTAGCAACTGCAAC<br>CGGTGTACATTCCCAGGTG<br>CAGCTGGTGCAGTCTGGG<br>CTGAGGTGAAGAAACCTGG<br>GGCTCAGTGAAGGTTTCC<br>TGCAAGGCATCTGGATACA<br>CCTTCACCAGCTACTATATG<br>CACTGGGTGCGACAGCCC<br>CTGGACAAGGGCTTGAGTG<br>GATGGGAATAATCAACCCT<br>AGTGGTGGTAGCACAACCT<br>ACGCACAGAAGTTCCAGGG | GNCCGCTGTNNNNNAGAGGT<br>GCTCTTGGAGGAGGGTGCC<br>AGGGGGAAGACCGATGGGC<br>CCTTGGTGAGGCTGAGGA<br>GCCCCAGTACCCCCAATA<br>GGTAATAACCACTACTATC<br>CCTCGGTCTCGGCCCGATCT<br>CTAGCACAGTAATACACGG<br>CCGTGTCCTCAGATCTCAG<br>GCTCCTCAGCTCATGTAG<br>ACTGTGCTCGTGGACGTGT<br>CCCTGGTCATGGTGACTCTG<br>CCCTGGAACTTCTGTGCGTA<br>GGTTGTGCTACCACCACTA<br>GGGTTGATTATTCCCATCCA<br>CTCAAGCCCTTGTCCAGGG<br>GCCTCTGCGACCCAGTGCA | COV21_P3<br>G5 | TACACATACGATTTAGGT<br>GACATTATAGAATAAC<br>ATCCACTTTTGCCTTTCTC<br>TCCACAGGTGTCCACTCC<br>CAGGTCCAACTGCACCT<br>CGGTTCTATCGATTGAAT<br>TCCACCATGGGANGNC<br>ATGTATCATCCTTTTTCT<br>AGTAGCAACTGCAACCG<br>GTGTACATTCCCCCTG<br>TCTGCATCTGTAGGAGA<br>CAGAGTCACCATCACTT<br>GCCGGGCAAGTCAGAGC<br>ATTAGCAGCTATTTAAAT<br>TGGTATCAGCAGAAACC<br>AGGGAAAGCCCCTAAGC<br>TCCTGATCTATGCTGCAT<br>CCAGTTTGCAAAGTGGG<br>GTCCCATCAAGGTTCAGT | GGGGCCACCGGTGTACATTC<br>CCTCCCTGTCTGCATCTGTA<br>GGAGACAGAGTCACCATCA<br>CTTGCCGGGCAAGTCAGAG<br>CATTAGCAGCTATTTAAATT<br>GGTATCAGCAGAAACCAGG<br>GAAAGCCCCTAAGCTCCTGA<br>TCTATGCTGCATCCAGTTTG<br>CAAAGTGGGGTCCCATCAA<br>GGTTCAGTGGCAGTGGATCT<br>GGGACAGATTTCACTCTCAC<br>CATCAGCAGTCTGCAACCTG<br>AAGATTTTGCAACTTACTAC<br>TGTCAACAGAGTTACAGTAC<br>CCCACCGTCGTTCGGCCAAG<br>GGACCAAGGTGAAATCAA<br>ACGGTGGAGGCACCAAGCT<br>GGAAATCAAACGTACGGGC<br>A (SEQ ID NO: 3321) | COV21_P3<br>G5 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | CAGAGTCACCATGACCAGG GACACGTCCACGAGCACAG TCTACATGGAGCTGAGCAG CCTGAGATCTGAGGACACG GCCGTGTATTACTGTGCTAG AGATCGGGCCGAGACCGAG GGATCGGAAACGTATTACT ATGATAGTAGTGGTTATTA CCTATTGGGTACTGGGGC CAGGGAACCCTGGTCACCG TCTCCTCAGCGTCGACCAA GGGCCCATCGGTCTTCCCCC TGGCACCCTCCTCCAAGAG CACCTCTGGGGGCACAGCG GCCCTGGGCTGCCTGGTCA AGGACTACTTCCCCGAACC TGTGACGGTCTCGTGGAAC TCAGGCGCCCTGACCAGCG GCGTGCACACCTTCCCGGC TGTCCTACAGTCCTCANGA CTCTACTCCCTCAGCAGCGT GGTGACCGTGCCCTCCAGC AGCTTGGGCACCCAGACCT ACATCTGCAACGTGAATCA CAAGCCCAGCAACACCA (SEQ ID NO: 3318) | TATAGTAGCTGGTGAAGGT GTATCCAGATGCCTTGCAG GAAACCTTCACTGAGGCGC CAGGTTTCTTCACCTCAGCC CCAGACTGCACCAGCTGCA CCNNNGACANGACCCC (SEQ ID NO: 3319) | | GGCAGTGGATCTGGGAC AGATTTCACTCTCACCAT CAGCAGTCTGCAACCTG AAGATTTGCAACTTACT ACTGTCAACAGAGTTAC AGTACCCCACCGTCGTTC GGCCAAGGGACCAAGGT GGAAATCAAACGTGTGA GGCACCAAGCTGGAAAT CAAACGTACGGTGGCTG CACCATCTGTCTTCATCT TCCCCCATCTGATGAGC AGTTGAAATCTGAACT GCCTCTGTTGTGTGCCTG CTGAATAACTTCTATCCC AGAGAGGCCAAAGTACA GTGGAAGGTGGATAACG CCCTCCAATCGGGTAACT CCCAGGAGAGTGTCACA GAGCAGGACAGCAAGGA CAGCACCTACAGCCTCA GCAGCACCCTGACGCTG AGCAAAGCAGACTACGA GAAACACAAAGTCTACG CCTGCGAAGTCACCCAT CAGGGCCTGAGCTCGCC CGTCACAAAGAGCTTCA ACAGGGGAGAGTGTTAG AAGCTTGGCCGCCATGG CCCAACTTGTTTATTGCA GCTTATAATGGTTACAA ATAAAGCAATAG (SEQ ID NO: 3320) | | |
| COV21_P3 E7 | A-C021 | TACACATACGATTAGGTG ACACTATAGAATAACATCC ACTTTGCCTTTCTCTCCACA GGTGTCCACTCCCAGGTCC GAATGCACCTCGGTTCTATC GATTGAATTCCACCATGGG ATGGTCATGTATCATCCTTT TTCTAGTAGCAATGCAAC CGGTTGTACAATTCCCAGGTG CAGCTGCAGGAGTCGGGC CAGGACTGGTGAAGCCTTC | GCTGTGTGNNNNNGAGTGCT CTTGGAGGAGGGTGCCAGG GGGAAGACCCAATGGGCCCT TGGTGGAGGCTGAGGAGAC TGGACCAGGGTTCCCTGG CCCCAGTAGTCAAGGAAC CACTACTATCATAGTATTGC CAAACTCTCCGCACAGTAAT ACACGGCCGTGTCCGGGC AGTCACAGAGCTCAGCTTC AGGGAGAACTGGTTCTTAG | COV21_P3 E7 | TACACATACGATTAGGT GACACTATAGAATAACA TCCACTTTGCCTTTCTCT CCACAGGTGTCCACTCCC AGGTTCTAACTGCACCTC GGTTCTATCGATTGAATT CCACCATGGGATGGTCA TGTATCATCCTTTTTCTA GTAGCAACTGCAACCGG TGTACATGGGAATGTCA | TNNCCGATTGGAGGGCGTTA TCCACCTTCCACTGTACTTT GGCCTCTCTGGGATAGAAGT TATTCAGCAGGCACACAAC AGAGGCAGTTCCAGATTTCA ACTGCTCATCAGATGGCGGG AAGATGAAGACAGATGTG CAGCCACCAGTTCGTTTGATA TCAACTTTGGTCCCAGGCC GAAAGTGAATGAGTTTGT AGAGCTTGCATGCAGTAATA | COV21_P3 E7 |

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | original nt sequence | sequence ID (plate/well) |
| | | ACAGACCCTGTCCCTCACCT GCACTGTCTCTGGTGGCTCC ATCAGCAGTGTGGTTACT ACTGGAGCTGGATCCGCCA GCACCCAGGGAAGGGCCTG GAGTGGATTGGGTACATCT ATTACAGTGGAGCACCTA CTACAACCCGTCCCTCAAG AGTCAGTTACCATATCAG TAGACACGTCTAAGAACCA GTTCTCCCTGAAGCTGAGCT CTGTGACTGCCGCGGACAC GGCCGTGTATTACTGTGCG AGAGTTTGGCAATACTATG ATAGTAGTGGTTCCTTTGAC TACTGGGGCCAGGGAACCC TGGTCACCGTCTCCTCAGCG TCGACCAAGGGCCCATCGG TCTTCCCCCTGGCACCCTCC TCCAAGAGCACCTCTGGGG GCACAGCGGCCCTGGGCTG CCTGGTCAAGGACTACTTC CCCGAACCTGTGACGGTCT CGTGGAACTCANGCGCCCT GACCAGCGGCGTGCACACC TTCCCGGCTGTCCTACAGTC CTCAGGACTCTACTCCCTCA GCAGCGTGGTGACCGTGCC CTCCAGCAGCTTGGGCACC CAGACCTACATCTGCAACG TGAATCACAAGCCCAGCAA CACCAAGGTGGACAAGAGA GTTGAGCCCAAATCTTGTG ACAAAACTCACACATGCCC ACCGTGCCCAGCACC (SEQ ID NO: 3322) | ACGTGTCTACTGATATGGT AACTCGACTCTTGAGGGAC GGGTTGTAGTAGGTGCTCC CACTGTAATAGATGTACCC AATCCACTCCAGGCCCTTCC CTGGGTGCTGGCGGATCCA GCTCCAGTAGTAACCACCA CTGCTGATGGAGCCACCAG AGACAGTGCAGGTGAGGGA CAGGGTCTGTGAAGGCTTC ACCAGCTCCTGGGCCCGACT CCTGCAGCTGCACCT (SEQ ID NO: 3323) | | AACCCCAACATCTCAGCCT CCACTCTGCTCTGATTTCAGT GTAAAATCTGTGCCTGATCC ACTGCCACTGAACCTGTCAG GGACCCCGGAGGCCCGATT AGAACCCAAATAGATCAGG AGCTGTGGAGACTGCCCTGG CTTCTGCAGGTACCAATCCA AATAGTTGTATCCATTACTA TGCAGGAGGCTCTGACTAG ACCTGACGAGGATGAGGC CGGCTCTTCCAGGGTGACG GGCAGGGAGGATGGA (SEQ ID NO: 3325) | |
| COV21_P2 E6 | A-C029 | TACACATACAGATTAGGTG ACACTATAGAATAACATCC ACTTTGCCTTTCTCCACA | GCTNNGCCCAGAGTGCT CTTGGAGGAGGGTGCCAGG GGGAAGACCATGGCCCT | COV21_P2 E6 | TTNCCCGATTGGAGGGCGTT ATCCACCTTCCACTGTACTT TGCCTCTCTGGGATAGAAG | COV21_P2 E6 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | GGTGTCCACTCCCA TABLE 15-continued Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| COV21_P1 B10 | | | | | TGGCCGCCATGGCCCAA CTTGTTTATTGCAGCTTA TAATGG (SEQ ID NO: 3328) | | |
| | A-C022 | TACACATACGATTTAGGTG ACACTATAGAATAACATCC ACTTTGCCTTTCTCTCCACA GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGTTGCAGAGTCGGGCC CAGGACTGGTGAAGCCTTC GGAGACCCTGTCCTCACT TGCACTGTCTCTGGTGGCTC CATCAGCAGTAGTAGTAC TACTGGGGCTGGATCCGC AGCCCCCAGGGAAGGGCT GGAGTGGATTGGGAGTATC TATTATAGTGGGAGCACCT ACTACAACCCGTCCCTCAA GAGTCGAGTCACCATATCC GTGGACACGTCCAAGAACC AGTTCTCCCTGAAGCTGAG CTCTGTGACCGCCGAGAC ACGGCTGTGTATTACTGTGC GAGACATGCGGCAGCATAC TATGATAGAAGTGGTTATT ATTTCATCGAATACTTCCAG CACTGGGGCCAGGGCACCC TGGTCACCGTCTCTCAGCC TCCACCAAGGGCCCATCGG TCTTCCCCCTGGCACCCTCC TCCAAGAGCACCTCTGGGG GCACAGCGGCCCTGGGCTG CCCGAACCTGTGACGTCT CGTGGTCAAGGACTACTTC CGTGAACTCANGCCGTCT GACCAGCGGCGTGCACACC CTCCCGGCTGTCTACTCCCTCA CTCAGGACTTCTACTCCCTCA GCAGCGTGGTGACCGTGCC | GCTGTGCCCAGAGTGCT CTTGGAGGAGGTGCCAGG GGGAAGACCCATGGGCCCT TGGTGGAGGCTGAGGAGAC GGTGACCAGGGTGCCCTGG CCCCAGTGCTGGAAGTATT CGATGAAATAATAACCACT TCTATCATAGTATGCTGCG CATGTCTCCGCACAGTAATA CACAGCCGTGTCTGCGGCG GTCACAGAGCTCAGCTTCA GGGAGAACTGGTTCTTGGA TGCACTGTCTCTGGTGGCTC ACTCGACTCTTGAGGGACG GGTTGTAGTAGGTGCTCCC ACTATAATAGATACTCCCA ATCCACTCCAGCCCCTTCCC TGGGGCTGGCCGGATCCAG CCCCAGTAGTACCTACTACT GCTGATGGAGCCACCAGAG ACAGTGCAAGTGACGACA GGGTCTCCGAAGCTTCAC CAGTCCTGGGCCCGACTCC NG (SEQ ID NO: 3331) | COV21_P1 B10 | TACACATACGATTTAGGT GACATACTAGAATAACA TCCACTTTGCCTTTCTCT CCACAGGTGTCCACTCCC AGTTCCAACTGCACCTC GGTTCTATCGATTGAATT CCACCATGGAGATGGTCA TGTATCATCCTTTTTCTA GTAGCAACTGCAACCGG TGTACATTCTGACATCCA GATGACCCAGTCTCCTTC CACCCTGTCTGCATCTGT AGGAGACAGCGTCACCA TCACTTGCCGGGCCAGTC AGAGTATTAGTAGCTGG TTGCCTGGTATCAGCA GAAACCAGGGAAAGCCC CTAAGCTCCTGATCTATA AGGCTCTAGTTTTAGAA AGTGGGGTCCCATCAAG GTTCAGCGGCAGTGGAT CTGGGACAGAATTCACT CTCACCATCAGCAGCCT GCAGCCTGATGATTTTGC AACTTATTACTGCCAACA GTATAATAATTACCGGT ACACTTTTGGCCAGGGG ACCAAGCTGGAGATCAA ACGTACGGTGGCTGCAC CATCGTCTTCATCTTCC CGCCATCTGATGAGCAG TTGAAATCTGAACTGC TCTGTTGTGTGCCTGCT GAATAACTTCTATCCCAG AGAGGCCAAAGTACAGT GGAAGGTGGATAACGCC CTCCAATCGGTAACTCC GCAGAGAGTGTCACAGA GCAGGACAGCAAGGACA GCACCTACAGCCTCAGC | CTGGNNTTNCCCGATTGGAG GGCGTTATCCACCTTCCACT GTACTTTGCCTCTCTGGGA TAGAAGTTATTCAGCAGGCA CACAACAGAGGCAGTTCCA GATTTCAACTGCTCATCAGA TGGCGGGAAGATGAAGACA GATGGTGCAGCCACAGTTCG TTTGATCTCCAGCTTGGTCC CCTGGCCAAAAGTGTACCG GTAATTATTATACTGTTGGC AGTAATAAGTTGCAAAATC ATCAGGCTGCAGGCTGCTGA TGGTGAGTGAATTCTGTC CCAGATCCACTGCCGCTGAA CCTTGATGGGACCCCCACTTT CTAAACTAGACGCCTTATAG ATCAGGAGCTTAGGGGCTTT CCCTGGTTTCTGCTGATACC AGGCCAACCAGCTACTAAT ACTCTGACTGGGCCGGCAAG TGATGGTGACGCTGTCTCCT ACAGATGCAGACAGGG (SEQ ID NO: 3333) | COV21_P1 B10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | CTCCAGCAGCTTGGGCACC<br>CAGACCTACATCTGCAACG<br>TGAATCACAAGCCCAGCAA<br>CACCAANNGGACAAGAGA<br>GTTGAGCCCAAATTTGTG<br>AC (SEQ ID NO: 3330) | | | AGCACCCTGACGCTGAG<br>CAAAGCAGACTACGAGA<br>AACACAAAGTCACCC<br>TGCGAAGTCACCCATCA<br>GGGCCTGAGCTCGCCCG<br>TCACAAAGAGCTTCAAC<br>NGGGGAGAGTGTTAGAA<br>GCTTGGNCGCCATGGCC<br>CAACTTGTTTATTGCAGC<br>TTATAATGG (SEQ ID<br>NO: 3332) | | |
| COV21_P1<br>G4 | A-C027 | TACACATACGATTTAGGTG<br>ACACTATANAATAACATCC<br>ACTTTGCCTTTCTCTCCACA<br>GGTGTCCACTCCCAGGTCC<br>AACTGCCACCTCGGTTCTATC<br>GATTGAATTCCACCATGGG<br>ATGGTCATGTATCATCCTTT<br>TTCTAGTAGCAGTCTCCACC<br>CGGTGTACATTCTGAGGTG<br>CAGCTGGTGGAGTCTGGGG<br>GAGGCGTGGTCCAGCCTGG<br>GAGGTCCCTGAGACTCTCC<br>TGTGCAGCCTCTGGATTCAC<br>CTTCAGTAGCTATGCCATG<br>CACTGGGTCCGCCAGGCTC<br>CAGGCAAGGGCTGGAGTG<br>GGTGGCAGTTATATCATAT<br>GATGGAAGTAATAAATACT<br>ATGCAGACTCCGTGAAGGG<br>CCGATTCACCATCTCCAGA<br>GACAATTCCAAGAACACGC<br>TGTATCTGCAAATGAACAG<br>CCTGAGAGTTGAGGACACG<br>GCTGTGTATTACTGTGCGA<br>AAGCAAGTGGAATTTATTG<br>TAGTGTGGAGACTGCTAC<br>TCATACTACTTTGACTACTG<br>GGGCCAGGGAACCCTGGTC<br>ACCGTCTCCTCAGCGTGA<br>CCAAGGGCCCATCGGTCTT<br>CCCCCTGGCACCCTCCTCCA<br>AGAGCACCTCTGGGGGCAC<br>AGCGGCCCTGGGCTGCCTG | GCTGNGCCCCAGAGGTGCT<br>CTTGGAGGAGGGCTGCCAGG<br>GGGAAGACCGATGGGCCCT<br>TGGTGGAGGCTGAGGAGAC<br>GGTGACCAGGGTTCCCTGG<br>CCCCAGTAGTCAAAGTAGT<br>ATGAGTAGCAGTCTCCACC<br>ACTACAATAAATTCCACTT<br>GCTTTCGCACAGTAATACA<br>CAGCCGTGTCCTCAGCTCTC<br>AGGCTGTTCATTTGCAGAT<br>ACAGGCTGTTCTTGAATT<br>GTCTCTGGAGATGGTGAAT<br>CGGCCCTTCACGGAGTCTG<br>CATAGTATTTATTACTTCCA<br>TCATATGATATAACTGCCA<br>CCCACTCCAGCCCCTTGCCT<br>GGAGCCTGGCGGACCAGT<br>GCATGCCATAGCTACTGAA<br>GGTGAATCACCAGAGGCTGCA<br>CAGGAGAGTCTCAGGGACC<br>TCCAGGCTGGACCACGCC<br>TCCCCAGACTCCACCAGC<br>TGCA (SEQ ID NO:<br>3335) | COV21_P1<br>G4 | CGATTGGAGGCGTTATCCA<br>CCTTCCACTGTACTTTGGCC<br>TCTCTGGGATAGAAGTTATT<br>CAGCAGGCACACAACAGAG<br>GCAGTTCCAGATTTCAACTG<br>CTCATCAGATGCGGAAG<br>ATGAAGACAGATGGTGCAG<br>CCACAGTTCGTTTGATTTCC<br>ACCTTGTCCCTTGGCCGAA<br>CGTGAATAACTATTATACT<br>GTTGGCAGTAATAAGTTGCA<br>AAATCATCAGGCTGCAGGCT<br>GCTGATGGTGAGAGTGAATT<br>CTGTCCCAGATCCACTCCCG<br>CTGAACCTTGATGGGACCCC<br>ACTTTCTAAACATAGACGCCT<br>TATAGATCAGGAGCTTAGG<br>GGCTTTCCCTGGTTTTCTGCT<br>GATACCAGGCCAACCAGCT<br>ACTAATACTCGACTGCGCC<br>GGCAAGTGATGGGTGACTCTG<br>TCTCCTACAGATGCAGACAG<br>GGNG (SEQ ID NO:<br>3337) | COV21_P1<br>G4 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | GTCAAGGACTACTTCCCCG AACCTGTGACGGTCTCGTG GAACTCANGCGCCCTGACC AGCGGCGTGCACACCTTCC CGGCTGTCCTACAGTCCTCA GNACTCTACTCCCTCAGCA GCGTGGTGACCGTGCCCTC CAGCAGCTTGGGCACCCAG ACCTACATCTGCAACGTGA ATCACAAGCCCAGCAACAC CAAGTGGGNANNAGAGAGT TGAGCCCAAATCTTGTGAN AAAACTCACACATGCCC (SEQ ID NO: 3334) | | | ACTTCTATCCAGAGAG GCCAAAGTACAGTGGAA GGTGATAACGCCCTCC AATCGGGTAACTCCCAG GAGAGTGTCACAGAGCA GGACAGCAAGGACAGCA CCTACAGCCTCAGCAGC ACCCTGACCCTGAGCAA AGCANACTACGAGAAAC ACAAAGTCTACGCCTGC GAAGTCACCCATCNGGN CNTGANCTCCCCCGTCA CAAAGAGCTTCAACAGG GGAGAGTGTTAGAAGCT TGGCCGCCATGGCCCAA CTTGTTTATTGCAGCTTA TAATGGNTACAAATAAA GCAATAGCATCA (SEQ ID NO: 3336) | | |
| COV21_P2 B2 | A-C030 | TACACATACGATTTAGGTG ACATTATAGAATAACATCC ACTTTGCCTTTCTCCCACA GGTGTCCACTCCCAGTCC AACTGCACCTCCGGTTCTATC GATTGAATTCCACCATGGG ATGGTCATGTATCATCCTTT TTCTAGTAGCAACTGCAAC CGGTGTACATTCTGAGGTG CAGCTGGTGGAGTCTGGG GCTGCGTGGTCCAGCCTGG GAGGGTCCCTGAGACTCTCC TGTGCAGCCTCCGGATTCAC CTTCAGTAGCTATGGCATG CACTGGGTCCGCCAGGCTC CAGGGAAGGGGCTGGAGTG GGTGGCAGTTATATCATAT GATGGAAGTAATAAATACT ATGCAGACTCCGTGAAGG CCGATTCACCATCTCCAGA GACAATTCCAAGAACACG TGTATCTGCAAATGAACAG CCTGAGAGCTGAGGACACG GCTGTGTATTACTGTGCGA AAGCAAGTGGAATATATTG | AGAGGTGCTCTTGGAGGAG GGTGCCAGGGGGAAGACCG ATGGGCCCTTGGTGGAGGC TGAGGAGACGGTGACCAG GTTCCCTGGCCCCAGTAGTC AAAGTAGTATGAGTAGCAG TTACCACCACTACAATATAT TCCACTTGCTTTCGCACAGT AATACACAGCCGTGTCCTC AGTCTCCAGGCTGTTCATTT GCAGATACAGCGTGTTCTT GGAATTGTCTCTGGAGATG GTGAATCGGCCCTTCACG AGTCTGCATAGTATTTATTA CTTCCATCATATGATATAAC TGCCACCCACTCCAGCCCCT TGCCTGGAGCCTGGGGAC CCAGTGCATGCCATAGCTA CTGAAGGTGAATCCAGAGG CTGCACAGGAGAGTCTCAG GGACCTCCCAGGCTGACC ACGCCTCCCCAGACTCCA NNNNCTGCAC (SEQ ID NO: 3339) | COV21_P2 B2 | TACACATACGATTTAGGT ATCCACCTTCCACTGTACTT TGGCCTCTCCTGGGATAGAAG TTATTCAGCAGGCACACAC AGAGGCAGTTCCAGATTCA ACTGCTCATCAGATGGCGGG AAGATGAAGACAGATGGTG CAGCCAGTTCGTTTGATT TCCACCTTGGTCCCTTGCC GAACGTCGAATAACTATTAT ACTGTTGCAGTAATAAGTT GCAAAATCATCAGGCTGCA GGCTGCTGATGGTGAGACT GAATTCTGTCCCAGATCCAC TGCCCGTTGAACCTTGATGGG ACCCCACTTTCTAAACTAGA CGCCTTATAGATGAGGAGCT TAGGGCTTTCCCTGGTTTC TGCTGATAATACTCTGACTGG GCTACTAATACTCTGACTGG CCCGGCAAGTGATGGTGACT CTGTCCTACAGATGCAGA CAGGGAGACTGGAGNNNG GGTCA (SEQ ID NO: 3341) | COV21_P2 B2 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| COV21_P1 A10 | TAGTGGTGTAACTGCTAC<br>TCATACTACTTTGACTACTG<br>GGGCCAGGGAACCCTGGTC<br>ACCGTCTCCTCAGCGTCGA<br>CCAAGGGCCCATCGGTCTT<br>CCCCCTGGCACCCTCCTCCA<br>AGAGCACCTCTGGGGCAC<br>AGCGGCCCTGGGCTGCCTG<br>GTCAAGGACTACTTCCCCG<br>AACCTGTGACGGTCTCGTG<br>GAACTCANGCGCCCTGACC<br>AGCGGCGTGCACACCTTCC<br>CGGCTGTCTACAGTCCTCN<br>NNCTCTACTCCCTCAGCAG<br>CGTGTGACCGTGCCCTCC<br>AGCAGCTTGGGCACCCAGA<br>CCTACATCTGCAACGTGAA<br>TCACAAGCCCAGCAACACC<br>ANNNGGACAAGANAGTTGA<br>GCCCAAATCTTGTGACAAA<br>ACTCACACATGCCCACCG<br>(SEQ ID NO: 3338) | | | GTATAATAGTTATTCGAC<br>GTTCGGCCAAGGGACCA<br>AGGTGGAAATCAAACGT<br>ACGTGGCTGCACCATC<br>TGTCTTCATCTTCCCGCC<br>ATCTGATGAGCAGTTGA<br>AATCTGGAACTGCCTCTG<br>TTGTGTGCCTGCTGAATA<br>ACTTCTATCCCAGAGAG<br>GCCAAAGTACAGTGGAA<br>GGTGGATAACGCCCTCC<br>AATCGGTAACTCCCAG<br>GAGAGTGTCACAGAGCA<br>NGACAGCAAGGACAGCA<br>CCTACAGCCTCAGCAGC<br>ACCCTGACCGTCAGCAGC<br>AGCAGACTACGAGAAAC<br>ACAAAGTCTACGCCTGC<br>GAAGTCACCCATCNGNC<br>CTGAGCTCGCCCGTCAC<br>AAAGAGCTTCAACAGGG<br>GANAGTGTTAGAAGCTT<br>GGCCGCCATGGCCCAAC<br>TTGTTTATTGCAGCTTAT<br>AATGGTTACAAATAAAG<br>CAATAGCATCAC (SEQ ID NO: 3340) | | COV21_P1 A10 |
| A-C031 | TACACATACGATTTAGGT<br>ACACTATAGAATAACATCC<br>ACTTTGCCTTTCTCTCCNCN<br>GGTGTCCACTCCCAGCTCC<br>AACTGCACCTCGGTTCTATC<br>GATTGAATTCCACCATGGG<br>ATGGTATAGCATCATCCTTT<br>TTCTAGTAGCAACTGCAAC<br>CGGTATAACACCAGCCGTGT<br>CAGCTGGTGAGTCTGGGG<br>GGGCTTGGTACAGCCTGG<br>GGGTCCCTGAGACTCTCC<br>TGTGCAGCCTCGGATTCAC<br>CTTCAGTAGCTACGACATG<br>CACTGGGTCCGCCAAGCTA<br>CAGGAAAAGGTCTGGAGTG<br>GGTCTCAGCTATTGTACTG | CGCTGTGCCCCNGAGGTGC<br>TCCTGGAGCAGGGCGCCAG<br>GGGAAGACCGATGGGCCC<br>TTGGTGAAGCTGAGGAGA<br>CAGTGACCAGGGTGCCACG<br>GCCCCAGAGATGAAGTAC<br>TATCATACCCTACTCTTGCA<br>CAGTAATACACAGCCGTGT<br>CCCCGGCTCTCAGGCTGTTC<br>ATTTGAAGATACAAGGAGT<br>TCTTGGCATTTCTTCTGGAG<br>ATGGTGAATGGGCCCTTCA<br>CGGAGCCTGGATAGTATGT<br>CTTCAGTAGCTACCAAATA<br>CACTGGGTCCGCCAAGCTA<br>GCTGAGAGCCCACTCCAGAC<br>CTTTTCCTGAGCTTGGCCG | COV21_P1 A10 | TACACATACGATTTAGGT<br>GACACTATAGAATAACA<br>TCCACTTTGCCTTTCTCT<br>CCACAGGTCCACTCCCC<br>AGTCCAACTGCACCTC<br>GGTTCTATCGATTGAATT<br>CCACCATGGGATGGTCA<br>TGTATCATACCTTTTCTA<br>GTAGCAACTGCAACCGG<br>TGTACATTCTGACATCCA<br>GATGACCCAGTCTCCATC<br>CTCCCTGTCCATCTGT<br>AGGAGACAGAGTCACCA<br>TCACTTGCCGGGCAAGT<br>CAGAGCATTAGCAGCTA<br>TTTAAATTGGTATCAGCA<br>GAAACCAGGGAAAGCCC | TACCCGATTGGAGGGCGTTA<br>TCCACCTTCCACTGTACTTT<br>GGCCCTCTCTGGGGATAGAAGT<br>TATTCAGCAGGCACACAAC<br>AGAGGCAGTTCCAGATTTCA<br>ACTGCTCATCAGATGGCGGG<br>AAGATGAAGACAGATGGTG<br>CAGCCACAGTTCGTTTGATC<br>TCCACCTTGGTCCTCCGCC<br>GAAAGTGAGCGGAGGGGTA<br>CTGTAACTCTGTTGACAGTA<br>GTAAGTTGCAAAATCTCAG<br>GTTGCAGACTGCTGATGGTG<br>AGAGTGAAATCTGTCCCAG<br>ATCCACTGCCACTGAACCTT<br>GATGGATGCAGCATAGATC<br>ACTGGATGCAGCATAGATC | COV21_P1 A10 |

TABLE 15-continued

Additional sequence information for the disclosed anti-SARS-CoV-2 antibodies

| ALICE | AbsID | HEAVY CHAIN | | | L

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | miniprep sequence | original nt sequence | sequence ID (plate/well) |
| | | CAGTGGTGGAGTCTGGGG GAGGCTTGGTACAGCCTGG CAGGTCCCTGAGACTCTCCT GTGCAGCCTCTGGATTCAC CTTTGATGATTATGCCATGC ACTGGGTCCGCAAGCTCC AGGGAAGGGCCTGGAGTGG GTCTCAGGCACTAGTTGGA ATAGTGGCACCATAGGCTA TGCCGACTCTGTGAAGGGC CGATTCACCATCTCCAGAG ACAACGCCAAGAACTCCCT GTATCTGCAAATGAACAGT CTGAGAGCTGAGGACACGG CCGTGTATTACTGTGCAAAA GGCAGGGTGGTGTATGCTA TAGACCCGGACTCGGTCTC GCCGTTTGACTACTGGGGC CAGGGAACCCTGGTCACCG TCTCCTCAGCGTCGACCAA GGGCCATGGTCTTCCCCCC TGGCACCCTCCTCCAAGAG CACCTGTGGGGCACAGCG GCCCTGGGCTGCCTGGTCA AGGACTACTTCCCCGAACC TGTGACGGTCTCGTGGAAC TCANGCGCCCTGACCAGCG GCGTGCACACCTTCCCGGC TGTCCTACAGTCCTCANGA CTCTACTCCCTCAGCAGCGT GGTGACCGTGCCCTCCAGC AGCTTGGGCACCCAGACCT ACATCTGCAACGTGAATCA CAAGCCCAGCAACACCAAN GTGGACAAGAGAGTTGAGC CCAAATCTTGTGACAAAAC TCACACATGCCACCG (SEQ ID NO: 3346) | GCCGTGTCCTCAGCTCTCAG ACTGTTCATTTGCAGATACA GGGAGTTCTTGGCGTTGTCT CTGGAGATGGTGAATCGGC CCTTCACAGAGTCCGCATA GCCTATGGTGCCACTATTCC AACTAGTGCCTGAGACCCA CTCCAGGCCCTTCCCTGGA GCTTGCCGGACCCAGTGCA TGGCATAATCATCCAAGGT GAATCCAGAGGCTGCACAG GAGAGTCTCAGGGACCTGC CAGGCTGTACCAAGCCTCC CCCAGACTCCACCAGCCTG CACCTANNATG (SEQ ID NO: 3347) | | TTCCTGGGCCAGTCTGC CCTGACTCAGCCTGCCTC CGTGTCTGGGTTCTCTGG ACAGTCGATCACCATCTC CTGCACTGGAACCAGCA GTGCGTTGGTGGTTATA ACTTTGTCTCCTGGTACC AACAACACCCAGGCAAA GCCCCAAACTCATGATT TATGATGTCAGTAATCG GCCCTCAGGGGTTTCTAA TCGCTTCTCTGGCTCCAA GTCTGGCAACACGGCCT CCCTGACCATCTCTGGGC TCCAGGCTGAGGACGAG GCTGACTATCACTGCAG CTCATATACAAGCAGGA GCACTCTGGGGTATTC GGCGGAGGGACCAAGCT GACCGTCCTAGGTCAGC CCAAGGCTGCCCCCTCG GTCACTCTGTTCCCACCC TCGAGTGAGGAGCTTCA AGCCAACAAGGCCACAC TGGTGTGTCTCATAAGTG ACTTCTACCCGGGAGCC GTGACAGTGGCCTGAA GGCAGATAGCAGCCCG TCAAGGCGGGAGTGGAG ACCACCACACCCTCCAA ACAAAGCAACAACAAGT ACGCGGCCAGCAGCTAC CTGACCCTGACGCCCTGA GCAGTGGAAGTCCACA GAAGCTACAGCTGCCAG GTCACGCATGAAGGGAG CACCGTGGANAAGAACAG TGGCCCTACAGAATGTTC ATAGAAGCTTGGCCGCC ATGNCCAACTTGTTTAT TGCAGCTTATAATGTTA CNAATAAAGCA (SEQ ID NO: 3348) | CCCCTGAGGGCCGATTACTG ACATCATAAATCATGAGTTT GGGGGCTTTGCCTGGGTGTT GTTGGTACCAGGAGACAAA GTTATAACCACCAACGCCAC TGCTGGTTCCAGTGCAGGAG ATGGTGATCGACTGTCCAGG AGACCCAGACACCGAGGCA GGCTGAGTCAGCACAGACT GGGACCAGGAACCGGTTGC NNNTNNCCTACTAGAA (SEQ ID NO: 3349) | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| COV21_P1 H8 | A-C023 | TACACATACGATTAGGTG ACACTATAGAATAACATCC ACTTTGCCTTTCTCCACA GGTGTCCACTCCCAGGTCC AACTGCAACTCGGTTCTATC GATTGAATTCCACCATGGG ATGGTCATGTATCATCCTTT TTCTAGTAGCAACTGCAAC CGGTGTACATTCTGAGGTG CAGCTGGTGGAGTCTGGGG GAGGCTTGGTACAGCCTGG GGGGTCCCTGAGACTCTCG TGTGCAGCCTCTGGATTCAC CTTCAGTAACTACGACATTC ACTGGGTCCGCCAAGCTAC AGGAGAAGGTCTGGAGTGG GTCTCAGCAATTGTACTG AGGCCTCCGTGAGGGCCGA TTCACCATCTCCAGAGAAA ATGCCAAGAACTCCGTGTT TCTTCAAATGAACAGCCTG AGAGCCGGGACACGGCTG TGTATTACTGTGCAGAGG TCGGGGACATTGTAGTAGT ATCAGCTGTTGCATAGTTG GTTCACTCCTGGGGCCAG GGAACCCTGGTCACCGTCT CCTCAGCGTCGACCAAGGG CCCATCCGTCTTCCCCTGG CACCCTCCTCCAAGAGCAC CTCTGGGGCTGCACAGGCC CTGGGCTGCCTGGTCAAGG ACTACTTCCCCGAACCTGTG ACGGTCTCGTGGAACTCAG GCGCCCTGACCAGCGGCGT GCACACCTTCCCGGCTGTCC TACAGTCCTCANGACTCTA CCCCCTCAGCAGCGTGGTG ACCGTGCCCTCCAGCAGCT TGGGCACCCAGACCTACAT CTGCAACGTGAATCACAAG CCCAGCAACACCAAGGTG GACNAGANAGTTGAGCCCA | TGAGGAGACGGTGACCAGG GTTCCCTGGCCCCAGGAGT CGAACCAACTATGCAAGCA GCTGATACTACTACAATGT CCCCGACCTCTTGCACAGT AATACACAGCCGTGTCCCC GGCTCTCAGGCTGTTCATTT GAAGAAACACGGAGTTCTT GGCATTTTCTCTGGAGATG GTGAATCGGCCCCTCACGG AGCCTGGATAGTATGTGTC ACCACCAGTACCAATTGCT GAGACCCCACTCCAGACCTT CTCCTGTAGCTTGGCGGAC ACAGTGAATGTCGTAGTTA CTGAAGGTGAATCCAGAGG CTGCACACGAGAGTCTCAG GGACCCCCCAGGCTGTACC AAGCCTCCCCAGACTCCA CCAGTCTGCACCTANNATG (SEQ ID NO: 3351) | COV21_P1 H8 | TACACATACGATTAGGTT GACACTATAGAATAACA TCCACTTTGCCTTTCTCT CCACAGGTGTCCACTCCC AGTTCCAACTGCACCTC GGTTCTATCGATTGAATT CCACCATGGGATGGTCA TTGTATCATCCTTTTTCTA GTAGCAACTGCAACCGG TTCCTGGGCCCAGTCTGT GCTGACGCGCCCTGT CAGTGTCTGGGGCCCA GGGCAGAGGGTCACCAT GCTCCAACATCGGGGCA GGTTCTGATGTACACTGG TACCAGAAACTTCCAGG AACAGCCCCAAAGTCC TCATCTATGGTTACAGCA ATCGGCCCTCAGGGGTC CCTGACCGATTCTCTGGC TCCAAGTCTGGCACCTCA GCCTCCCTGGCCATCACA GGGCTCCAGGCTGAGGA TGAGGCTGATTATTACTG CCAGTCCTATGACACCA GCTCTGAGGGTGGTATTC GGCGGAGGGACCAAGCT GACCGTCCTGGGTCAGC CCAAGGCTGCCCCCTCG GTCACTCTGTTCCCGCCC TCGAGTGAGGAGCTTCA AGCCAACAAGGCCACAC TGGTGTGTCTCATAAGTG ACTTTCTACCCGGAGCC GTGACAGTGGCTTGAA GGCAGATAGCAGCCCCG TCAAGCGGGAGTGGAG ACCACCACACCCTCCAA ACAAAGCACCAACAAGT ACGCGGCCAGCAGCTAC CTGAGCCTGACGCCTGA GCAGTGGAAGTCCACA GAAGCTACAGCTGCCAG | TGGGCTGACCCAGGACCGT CAGCTTGGTCCCTCCGCCGA ATACCACCCTCAGGCTGTG TCATAGGACTGGCAGTAATA ATCAGCCTCATCCTCAGCCT GGAGCCCTGTGATGGCCAG GGAGGCTGAGGTGCCAGAC TTGGAGCCAGAGAATCGGT CAGGGACCCCTGAGGGCCG ATTGCTGTAACCATAGATGA GGACTTTGGGGCTGTTCCT GGAAGTTTCTGGTACCAGTG TACATCAGAACCTGCTCCCAGTG TGTTGGAGCTGCTCCCAGTG CAGGAGATGGTGACCCTCTG CCCTGGGCGCCCCAGACACTG AGGGCGCTGAGTCAGCAC AGACTNGGCNCCNAGAANC GNNT (SEQ ID NO: 3353) | COV21_P1 H8 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AATCTTGTGACAAACTCA CACATGCCCACCGT (SEQ ID NO: 3350) | | | GTCACGCATGAAGGGAG CACCGTGGAGAAGACAG TGGCCCCTACAGAATGTT CATAGAAGCTTGGCCGC CATGGCCCAACTTGTTTA TTGCAGCTTATAATGGTT ACAAA (SEQ ID NO: 3352) | | |
| COV21_P1 B2 | A-C024 | TACACCATACGATTTAGGTG ACACTATAGAATAACATCC ACTTTGCCTTTCTCCACA GGTGTCCACTCCCAGGTCC AACTGGAATTCCACCAGT GATTGAATTCCACCATGGG ATGGTCATGTATCATCCTTT TTCTAGTAGCAACTGCAAC CGGTGTACAATTCTGAGGTG CAGCTGGTGGAGTCTGGGG GAGGCTTGGTACAGCCTGG GGGGTCCCTGAGACTCTCG TGTGCCAGCCTCTGGATTCAC CTTCAGTAACTACGACATG CACTGGGTCCGCCAAGTTA CAGGAGAAGGTCTGGAGTG GGTCTCAGCAATTGTACT GCTGGTGACACATACTATC CAGGCTCCGTGAAGGGCCG ATTCACCATCTCCAGAGAA AATGCCAAGAACTCCGTGT TTCTTCAAATGAACAGCCT GAGAGCCGGGGACGGCT GTGTATTACTGTGCAAGAG GTCGGGACATTGTAGTAG TATCAGCTGCTTGCATAGCT GGTTCGACTCCTGGGGCCA GGGAACCCTGGTCACCGTC TCCTCAGCCTCGACCAAGG GCCCATCGGTCTTCCCCCTG GCACCCTCCTCCAAGAGCA CCTCTGGGGCACGCGC CCTGGCTGCCTGGTCAAG GACTACTTCCCCGAACCTGT GACGGTCTCGTGGAACTCA GGCGCCCTGACCAGCGGCG | CTGAGGAGACGGTGACCAG GGTTCCCTGGCCCCAGGAG TCGAACCAGCTATGCAAGC AGTGATACTACTACCAATG TCCCCGACCTCTTGCACAGT AATACACAGCCGTGTCCCC GGCTCTCAGCGTGTTCATTT GAAGAAACACGGAGTTCTT GGCATTTCTGGAGATG GTGAATCGGCCCTTCACGG AGCCTGGATAGTATGTC ACCAGCAGTACCAATTGCT GAGACCCACTCCAGACCTT CTCCTGTAACTTGGCGGAC CCAGTGCATCGTAGTTA CTGAAGGTGAATCCAGAGG GGTCTCAGCAATTGTACT GACCCCCAGGCTGTACC AAGCCTCCTACAGACTCA CCAGCTGCACNNNACACTG NNACACC (SEQ ID NO: 3355) | COV21_P1 B2 | TACACCATACGATTTAGGT GACACTATAGAATAACA TCCACTTTGCCTTTCTCT CCACAGGTGTCCACTCCC AGGTCCAACTGCACCTC GGTTCTATCGATTGAATT CCACCATGGAGATGGTCA TGTATCATCCTTTTCTA GTAGCAACTGCAACGG TTCCTGGGCCCAGCCTGT GCTGACGCAGCCGCCT CAGTGTCTGGGGCCCA GGGCAGAGGTCACCAT CTCCTGCAGTGGGAGCA GCTCCAACATCGGGGCA GGTTCTGATGTACACTGG TACCAGAAACTTCCAGG AATAGCCCCCAAAGTCC TCATCTATGCTACAGCA ATCGGCCCCTCAGGGGTC CCTGACCGATTCTCTGGC TCCAAGTCTGGCACCTCA GCCTCCCTGGCCATCACA GGGCTCCAGGCTGAGGA TGAGGCTGATTATTACTG TGCAGCTCTATGACCA CCAGTCTATGACACCA GCTGAGGGTGGTATTC GGCGGAGGGACCAAGCT GACCGTCCTGGGTCAGC CCAAGGCTGCCCCCTG GTCACTCTGTTCCCACCC TCGAGTGAGAGCTTCA AGCCAACAAGGCCACAC ACTTCTACCCGGAGCC GTGACAGTGCCTGAA | TTGGGCTGACCCAGGACCGT CAGCTTGTGCCCTCCGCCGA ATACCACCCCTCAGGCTGGTG TCATAGGACTGGCAGTAATA ATCAGCCTCATCCTCAGCCT GGAGCCCTGTGATGGCCAG GGAGGCTGAGGTGCCAGAC TTGGAGCCAGAGAATCGGT CAGGGACCCCTGAGGGCCG ATTGCTGTAGCCATAGATGA GGACTTTGGGGCTATTCCT GGAAGTTTCTGGTACCAGTG TACATCAGAACCTGCCCCGA TGTTGGAGCTGCTCCCAGTG CAGGAGATGGTGACCCCTCTG CCCTGGGCGCCCAGACACTG AGGGCGCTGAGTCAGCAC AATAGCGGGACCNNGGAACCG GNN (SEQ ID NO: 3357) | COV21_P1 B2 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | TGCACACCTTCCCGGCTGTC CTACAGTCCTCAGGACTCT ACTCCCTCAGCAGCTGGT GACCGTGCCCTCCAGCAGC TTGGGCACCCAGACCTACA TCTGCAACGTGAATCACAA GCCCAGCAACCAACAANGTG GACAAGAGAGTTGAGCCCA AATCTTGTGACAAAACTCA CACATGCCCACCGTGCCC (SEQ ID NO: 3354) | | | GGCAGAGATAGCAGCCCCG TCAAGGCGGAGTGGAG ACCACCACCCTCCAA ACAAAGCAACAACAAGT ACGCGGCCAGCAGCTAC CTGAGCCTGACGCCTGA GCAGTGGAAGTCCCACA GAAGCTACAGCTGCCAG GTCACGCATGAAGGGAG CACCGTGGAGAAGACAG TGGCCCCTACAGAGATGTT CATAGAAGCTTGGCCGC CATGGCCCAACTTGTTTA TTGCAGCTTATAATGGTT ACAAATAAAGCAA (SEQ ID NO: 3356) | |
| COV21_P1 A12 | A-CO25 | TACACATACGATTTAGGTG ACACTATAGAATAACATCC ACTTTGCCTTTCTCTCCACA GGTGTCCACTCCCAGGTCC AACTGCACCTCGGTTCTATC GATTGAATTCCAACATGGG ATGGTCATGTATCATCCTTT TTCTAGTAGCAACTGCAAC CGGTGTACATTCTGAGGTG CAGCTGGTGGAGTCTGGGG GAGGCTTGGTACAGCCTGG GGGGTCCCTGAGACTCTCG TGTGCAGCCTCTGGATTCAC CTTCAGTAACTACGACATG CACTGGGTCCGCCAAGCTA CAGGAGAAGGTCTGGAGTG GGTCTCAGCAATTGGTACT GCTGGTGACACATACTATC CAGGCTCCGTGAAGGCCG ATTCACCATCTCCAGAGAA AATGCCAAGAACTCCGTGT TTCTTCAAATGAACAGCCT GAGAGCCGGGACACGGCT GTGTATTACTGTGCAAGAG GTCGGGACATTGTAGTAG TATCAGCTGCTTGCATAGCT GGTTCGACTTCCTGGGCCA GGGAACCCTGGTCACCGTC | GGTGACCAGGGTTNCCTGG CCCCAGGAGTCGAACCAGC TATGCAAGCAGCTGATACT ACTACAATGTCCCCGACCT CTTGCACAGTAATACACAG CCGTGTCCCGGCTCTCAG GCTGTTCATTTGAAGAAAC ACGGAGTTCTTGGCATTTTC TCTGGAGATGGTGAATCGG CCCTTCACGGAGCCTGGAT AGTATGTGTCACCAGCAGT ACCAATTGCTGAGACCCAC TCCAGACCTTCTCTCTGTAGC TTGCGGACCCCAGTGCATG TCGTAGTTACTGAAGGTGA ATCCAGAGGCTGCACACGA GAGTCTCAGGGACCCCCCA GGCTACCAAGCCTCCCC CAGACTCCACCANCTGCAC CTANNATG (SEQ ID NO: 3359) | COV21_P1 A12 | TACACATACGATTTAGGT GACTATAGAATAACA TCCACTTTGCCTTTCTCT CCACAGGTGTCCACTCCC AGGTCCAACTGCACCTC GGTTCTATCGATTGAATT CCACCATGGGATGGTCA TGTATCATCCTTTTTCTA GTAGCAACTGCAACCGG TTCCTGGGCCCAGTCTGT GCTGACGCAGCCGCCCT CAGTGTCTGGGGCCCCA GGGCAGAGGGTCACCAT CTCCTGCACTGGGAGTA GCTCCAACATCGGGGCA GGTTCTGATGTACACTGG TACCAGAAACTTCCAGG AACAGCCCCCAAAGTCC TCATCTATGGTTACAGCA ATCGGCCCTCGGGGTC CCTGACCGATTCTCTGGC TCCAAGTCTGGCACCTCA GCCTCCCTGGCCATCACA GGGCTCCAGCTGAGGA TGAGGCTGATTATTACTG CCAGTCCTATGACACCA GCCTGAGGTGGTATTC GGCCGAGGGACCAAGCT | CTTGGGCGTGACCCAGGACG GTCAGCTTGGTCCCTCCGCC GAATACCACCCTCAGGCTGG TGTCATAGGACTGGCAGTAA TAATCAGCCTCATCTCAGC CTGGAGCCCTGTGATGGCCA GGAGGGCTGAGGTGCCAGA CTTGGAGCCAGAGAATCGG TCAGGACCCCCGAGGCC GATTGCTGTAACCATAGATG AGGACTTTGGGGGCTGTTCC TGGAAGTTTCTGGTACCAGT TACATCAGAACCTGCCCCG ATGTTGGAGCTACTCCCAGT GCAGGAGATGGTGACCCTCT GCCCTGGGCCCCAGACACT GAGGGCGGCTGAGTCAGCA CAGACTGGGNCAGGAACC GGNN (SEQ ID NO: 3361) | COV21_P1 A12 |

TABLE 15-continued

Additional sequence information for the disclosed anti-SARS-CoV-2 antibodies

| ALICE | AbsID | HEAVY CHAIN | | LIGHT CHAIN | | |
|---|---|---|---|---|---|---|
| | | miniprep sequence | original nt sequence | sequence ID (plate/well) | miniprep sequence | original nt sequence | sequence ID (plate/well) |
| | | TCCTCAGCGTCGACCAAGG<br>GCCCATCGGTCTTCCCCCTG<br>GCACCCTCCTCCAAGAGCA<br>CCTCTGGGGCACAGCGGC<br>CCTGGCTCCTGGTCAAG<br>GACTACTTCCCCGAACCTGT<br>GACGGTCTCGTGGAACTCA<br>GGCGCCCTGACCAGCGGCG<br>TGCACACCTTCCCGGCTGTC<br>CTACAGTCCTCAGGACTCT<br>ACTCCCTCAGCAGCGTGGT<br>GACCGTGCCCTCCAGCAGC<br>TTGGGCACCCAGACCTACA<br>TCTGCAACGTGAATCACAA<br>GCCCAGCAACACCAANGTG<br>GACAAGAGAGTTGAGCCCA<br>AATCTTGTGACAAAACTCA<br>CACATGCCCACCGTGCCC<br>(SEQ ID NO: 3358) | | | GACCGTCCTGGGTCAGC<br>CCAAGGCTGCCCCCTCG<br>GTCACTCTGTTCCACCC<br>TCGAGTGAGGAGCTTCA<br>AGCCAACAAGGCCACAC<br>TGGTGTGTCTCATAAGTG<br>ACTTCTACCCGGAGCC<br>GTGACAGTGCCTGAA<br>GGCAGATAGCAGCCCG<br>TCAAGGCGGGAGTGGAG<br>ACCACCACCACCCTCCAA<br>ACAAAGCAACAACAAGT<br>ACGCGGCCAGCAGCTAC<br>CTGAGCCTGACGCCTGA<br>NCAGTGGAAGTCCACA<br>GAAGTACAGCTGCCAG<br>GTCACGCATGAAGGGAG<br>CACCTGGAGAAGACAG<br>TGGCCCCTACAGAATGTT<br>CATAGAAGCTTGGCCGC<br>CATGGCCCAACTTGTTTA<br>TTGCAGCTTATAATGTT<br>ACAAATAAAGCAAT<br>(SEQ ID NO: 3360) | |
| COV21_P1<br>D11 | A-C026 | TACACATACGATTTAGGT<br>ACACTATAGAATAACATCC<br>ACTTTGCCTTTCTCTCCACA<br>GGTGTCCACTTCCCAGGTCC<br>AACTGCCACTTCGGTTCTATC<br>GATTGAATTCCACATGGG<br>ATGGTCATGTATCATCCTTT<br>TTCTAGTAGCAACTGCAAC<br>CGGTGTACATTCTGAGGTG<br>CAGCTGGTGGAGTCTGGGG<br>GAGGCTTGGTACAGCCTGG<br>GGGGTCCCTGAGACTCTCG<br>TGTGCAGCCTCTGATTCAC<br>CTTCAGTAACTACGACATA<br>CACTGGGTCCGCCAGGCTA<br>CAGGAGAAGGTCTGGAGTG<br>GGTCTCAGCAATTGGTACT<br>GCTGGTGACACATCTATC<br>CAGGCTCCGTCGAAGGGCCG<br>ATTCACCATCTCCAGAGAA | CTGAGGAGANGGTGACCAG<br>GGTTCCCTGGCCCCAGGAG<br>TCGAACCAGCTATGCAAGC<br>AGCTGATACTACTACAGT<br>TCCCCGACCTCTTGCACAGT<br>AATACACCCGCCGTGTCCCC<br>GGCTCAGGCTGTTCATTT<br>GAAGAAACACGGAGTCTT<br>GGCATTTTCTCTGGAGATG<br>GTGAATCGGCCCTTCACGG<br>AGCCTGGATAGTATGTGTC<br>ACCAGCAGTACCAATTGCT<br>GAGACCCACTCCAGACCTT<br>CTTCAGTAACTACGACTA<br>CCAGTGTATGTCGTAGTTAC<br>TGAAGGTGAATTCAGAGGC<br>TGCACACAGAGTCTCAGG<br>GCTGGTGACACATCTATC<br>CAGGCTCCCAGGCTGTACCA<br>GACCCCCCAGGACTCCAC<br>CAGCTGCACCTANNATG | COV21_P1<br>D11 | TACACATACGATTTAGGT<br>GACTATAGAATAACA<br>TCCACTTTGCCTTTCTCT<br>CCACAGGTGTCCACTTCC<br>AGTTCCAACTGCACCTC<br>GGTTCTATCGATTGAATT<br>CCACCATGGGATGGTCA<br>TGTATCATCCTTTTTCTA<br>GTAGCAACTGCAACCGG<br>TTCCTGGGCACCCAGTCTGT<br>GCTGACGCAGCCGCCCT<br>CAGTGTCTGGGGCCCCA<br>GGGCAGAGGGTCACCAT<br>CTCCTGCACTGGGAGCA<br>GCTCCAACATCGGGGCA<br>GGTTCTGATGTACACTGG<br>TACCAGAAACTTCAGG<br>AACAGCCCCAAAGTCC<br>TCATCTATCTGTTACACA<br>ATCGGCCCCTCAGGGGTC | TTGGGCTGACCCAGGAGGAT<br>CAGCTTGGTCCCTCCGCCGA<br>ATACCACCCTCAAACTGTG<br>TCATAGGACTGGCAGTAATA<br>ATCAGCCTCATCCTCAGCCT<br>GGAGCCCTGTGATGCCAG<br>GGAGGCTGAGGTGCCAGAC<br>TTGGAGCCAGAGAATCGT<br>CAGGGACCCCTGAGGGCCG<br>ATTGTTGTAACCATAGATGA<br>GGACTTTGGGGCTGTTCCT<br>GGAAGTTTCTGGGTACCAGTG<br>TACATCAGAACCTGCTCCCAGTG<br>TGTTGGAGCTGCTCCCAGTG<br>CAGGAGATGGTGACCCTCTG<br>CCCTGGGCGCTGAGTCAGCAC<br>AGGGCGCTGAGTCAGCAC<br>GACTGGGNNNNGGAACCG<br>GNTGNNNNTG (SEQ ID<br>NO: 3365) | COV21_P1<br>D11 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | A-C032 | AATGCCAAGAACTCCGTGT TTCTTCAAATGAACAGCCT GAGAGCCGGGACACACGCG GTGTATTACTGTGCAAGAG GTCGGGGACATTGTAGTAG TATCAGCTGCTTGCATAGCT GGTTCGACTTCCTGGGGCCA GGGAACCCTGTCACCGTC TCCTCAGCGTCGACCAAGG GCCCATCGGTCTTCCCCCTG GCACCCTCCTCCAAGAGCA CCTCTGGGGCTGCTGGTCAAG CCTGGGCTGCCTGGTCAAG GACTACTTCCCCGAACCTGT GACGTCTCGTGGAACTCA NGCGCCCTGACCAGCGGCG TGCACACCTTCCCGGCTGTC CTACAGTCCTCANGACTCT ACTCCCTCAGCAGCCTGGT GACCGTGCCCTCCAGCAGC TTGGGCACCCAGACCTACA TCTGCAACGTGAATCACAA GCCCAGCAACACCAAGGTG GACAGANAGTTGAGCCCAA ATCTTGTGACAAAACTCAC ACATGCCCACCGTGCCC (SEQ ID NO: 3362) | (SEQ ID NO: 3363) | | CCTGACCGATTCTCTGGC TCCAAGTCTGGCACCTCA GCCTCCCTGGCCATACA GGGCTCCAGGCTGAGGA TGAGGCTGATTATTACTG CCAGTCCTATGACACCA GTTTGAGGGTGGTATTCG GCGGAGGGACCAAGCTG ACCGTCCTGGGCAGCC CAAGGCTGCCCCCTCGG TCACTCTGTTCCCGCCCT CGAGTGAGGAGCTTCAA GCCAACAAGGCCACACT GGTGTGTCTCATAAGTG ACTTCTACCCGGAGCC GTGACAGTAGCAGCCCCG GGCAGATAGCGGGAGTGGAG TCAAGGCGGGAGTGGAG ACCACCACCCCCCAA ACAAAGCAACAACAAGT ACGCGGCCAGCAGCTAC CTGAGCCTGACGCCTGA GCAGTGGAAGTCCACA GAAGCTACAGTGCCAG GTCACGCATGAAGGGAG CACCGTGAGAAGACAG TGGCCCCTACAGAATGTT CATAGAAGCTTGGCGC CATGCCCAACTTGTTTA TTGCAGCTTATAATGGTT ACAAATAAAGCAAT (SEQ ID NO: 3364) | | COV57_P1 F6 |
| COV57_P1 F6 | | TACACATACGATTAGGTG ACACTATAGAATAACA ACTTTGCCTTTCTCCACA GGTGTCCACTCCCAGTCC AACTGCACCTCGGTTCTATC ATGGTCATGTATCATCCTTT TTCTAGTACAATCCAAC CGGTGTCCAGGCCTTCAG GCTGCTCACTGCAGTTGT CAGGTGTGAAAAGCCCGG GGAGTCTGAAGATCTCC | GNNGCTGTGCCCCAGAGGT GCTCTTGGAGGAGGGTGCC AGGGGAAGACCGATGGGC CCTTGGTGGAGGCTGAGGA GACAGTGACCAGGTGCCA CGGCCCCAGATGATCCATGG ACCAGTCCAGTGCTACCCCT CTCGACAGTAATACATGG CGGTGTCCAGGCCTTCAG GCTGCTCACTGCAGTTGT CGGGTGCTGATGAGTGACCTG CGGCTGAGATGGTGACCTG | COV57_P1 F6 | TACACATACGATTAGGT GACCTTGGTCCCAGTTCCG AAGACATAAAGGGCACTCA GGCTGCTGTCATAGGACTGG CAGTAATAATCAGCCTCATC CTCAGCCTGGGAGCCCAGTGA TGGCCAGGGAGGCTGAGGT GCCAGACTTGGAGCCAGAG AATCGGTCAGGAGACCCCTG AGGGCCGATTGCTGTTACCA TAGATGAGGAGTTTGGGGG CTGTTCCTGGAAGCTGCTGG | CTTGGGCTGACCTAGGACGG TGACCTTGGTCCCAGTTCCG AAGACATAAAGGGCACTCA GGCTGCTGTCATAGGACTGG CAGTAATAATCAGCCTCATC CTCAGCCTGGGAGCCCAGTGA TGGCCAGGGAGGCTGAGGT GCCAGACTTGGAGCCAGAG AATCGGTCAGGAGACCCCTG AGGGCCGATTGCTGTTACCA TAGATGAGGAGTTTGGGGG CTGTTCCTGGAAGCTGCTGG | COV57_P1 F6 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | TGTAAGGGTTCTGGATACA GCTTTACCAGCTACTGGATC GGCTGGGTGCGCCAGATGC CCGGGAAAGGCCTGGAGTG GATGGGGATCATCTATCCT GGTGACTCTGATACCAGAT ACAGCCGTCTCTTCCAAGG CCAGGTCACCATCTCAGCC GACAAGTCCATCAGCACCG CCTACCTGCAGTGGAGCAG CCTGAAGGCCTCGGACACC GCCATGTATTACTGTGCGA GAGGGGTAGCAGTGGACTG GTACTTCGATCTCTGGGGCC GTGGCACCCTGGTCACCGT CTCCTCAGCGTCGACCAAG GGCCCATCGGTCTTCCCCCT GGCACCCTCCTCCAAGAGC ACCTCTGGGGCACGCGG CCCTGGGCTGCCTGGTCAA GGACTACTTCCCCGAACCT GTGACGGTCGTGGAACCT CAGGCCCCTGGCTGCCTG CGTGCACACCTTCCCGGCT GTCCTACAGTCCTCAGGAC TCTACTCCCTCAGCAGCGTG GTGACCGTGCCCTCCAGCA GCTTNNCACCCAGACCTAC ATCTGCAACGTGAATCACA AGCCCAGCACCACCAAGGT GGACAAGAGAGTTGAGCCC AAATCTTGTGACAAAACTC ACACATGCCCACCGTGCCC AGCACC (SEQ ID NO: 3366) | GCCTTGGAAGGACGGGCTG TATCTGGTATCAGAGTCAC CAGGATAGATGATCCCCAT CCACTCCAGGCCCTTTCCCGG GCATCTGGCGCCACCCAGCC GATCCAGTAGCTGGTAAAG CTGTATCCAGAAACCTTAC AGGAGATCTTCAGAGACTC CCCGGGCTCTTTTCACCTCTG CTCGAAGGCCTGCACCACC CAC (SEQ ID NO: 3367) | | GGCAGAGGGTCACCATC TCCTGCACTGGGAGCAG CTCCAACATCGGGGCAG GTTATGATGTACACTGGT ACCAGCAGCTTCCAGGA ACAGCCCCCAAACTCCT CATCTATGGTAACAGCA ATCGGCCCTCAGGGGTC CCTGACCGATTCTCTGGC TCCAAGTCTGGCACCTCA GCCTCCTCCCTGGCCATCACT GGGCTCCAGGCTGAGGA TGAGGCTGATTATTACTG CCAGTCCTATGACAGCA GCCTGAGTGCCCCTTTATG TCTTCGGAACTGGGACC AAGTCACCGTCCTAGG TCAGCCCAAGGCCAACC CCACTGTCTACTCTGTTCC CACCCTCGAGTGAGGAG CTTCAAGCCAACAAGGC CACACTGGTGTGTCTCAT AAGTGACTTCTACCCGG GAGCCTGACAGTGCC TGGAAGGCAGATAGCAG CCCCGTCAAGGCGGGAG TGGAGACCACCACCC TCCAAACAAGCACAA CAAGTACGCGGCCAGCA GCTACCTGAGCCTGACG CCAGAGAAGCTACAGCT GCCAGGTCACGCATGAA GGGAGCACCGTGGAGAA GACAGTGGCCCCTACAG AATGTTCATAGAAGCTT GGCCGCCATGGCCCAAC TTGTTTATTGCAGCTTAT AAT (SEQ ID NO: 3368) | TACCAGTGTACATCATAACC TGCCCCGATGTTGGAGCTGC TCCCAGTGCAGGAGATGT GACCCTCTGCCCTGGGGCCC CAGACACTGAGGGCGGCTG AGTCAGCACAGACTGGGAC CAGGAACCGGNTG (SEQ ID NO: 3369) | |
| COV57_P2 F10 | A-C033 | TACACATACGATTTAGGTG ACATATAGAATAACATCC ACTTTGCCTTTCTCCACA GGTGTCCACTCCCAGTCC | AGAGGTGCTCTTGAGGAG GGTGCCAGGGGGAAGACCG ATGGCCCTTGGTGGAGGC TGAGAGACCCTGACGTG | COV57_P2 F10 | TACACATACGATTTAGGTG ACACTATAGAATAACA TCCACTTTGCCTTTCTCT CCACAGGTGTCCACTCCC | TACCGATTGGAGGGCGTTAT CCACCTTCCACTGTACTTTG GCCTCTCGGATAGAAGTT ATTCAGCAGGCCACACACA | COV57_P2 F10 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AACTGCACCTCGGTTCTATC GATTGAATTCCACCATGGG ATGGTCATGTATCATCCTTT TTCTAGTAGCAACTGCAAC CGGTTGTACATTCCCAGGTG CAGCTGCAGGAGTCGGGCC CAGGACTAGTGAAGACCTTC GGAGACCCTGTCCCTCACC TGCACTGTCTCTGGTGCCTC CATCAATAGTTACTACTGG ACCTGGATCCGGCAGCCCC CAGGGAAGGGACTGGAATG GATTGGATATATCCATGAC AGTGGGAACACCAACTACA ACCCGCTCCAGGAGTCG AGTCACCATATCACTAGAC ACGTCGAAGAATCAGTTCT CCCTGAAGGTGAGGTCTGT GACCGCTGCCGACACGGCC GTCTATTACTGTGCGAGAG AGTAGTAGTACAATCTGC AAAAGATTGGTCTCACTAC TACTACTACATGGACGTCT GGGGCAAAGGGACCACGGT CACCGTCTCCTCAGCGTCG ACCAAGGGCCCATCGGTCT TCCCCCTGGCACCCTCCTC AAGAGCACCTCTGGGGGCA CAGCGCCCTCGGGCTGCCT GGTCAAGGACTACTTCCCC GAACCTGTGACGGTCTCGT GGAACTCAGCGCCCTGAC CAGCGGCGTCCACACCTTC CCGGCTGTCCTACAGTCCTC AGGACTCTACTCCCTCAGC AGCGTGGACCGTGCCCT CCAGCAGCTTGGGCACCCA GACCTACATCTGCAACGTG AATCACAAGCCCAGCAACA CCAAGGTGGACAAGAGAGT TGAGCCCAAATCTTGTGAC AAAACTCACACATGCCCA (SEQ ID NO: 3370) | GTCCCTTTGCCCCAGACGTC CATGTAGTAGTAGCAGTGA GACCAATCTTTGCAGATTG TACTACTACCTCTCTCGCAC AGTAATAGACGGCCGTGTC CGCAGCGGTCACAGACCTC ACCTTCAGGGAGAACTGAT TCTTCGACGTGTCTAGTGAT ATGGTGACTCGACTCCTGA GGGCGGGGTTGTAGTTGGT GTTCCCACTGTCATGGATAT ATCCAATCCATTCCAGTCCC TTCCCTGGGGGCTGCCGGA TCCAGGTCCAGTAGTAACT ATTGATGGAGGCACCAGAG ACAGTGCAGGTGAGGGACA GGGTCTCCGAAGGCTTCAC TAGTCCTGGGCCCGACTCC NGCAGCCTGCACCT (SEQ ID NO: 3371) | | AGGTCCAACTGCACCTC GGTTCTATCGATTGAATT CCACCATGGGATGGTCA TGTATCATCCTTTTTCTA GTAGCAACTGCAACCGG TGTACATTCAGAAATTGT GTTGACACAGTCTCCAG CCACCCTGTCTTTGTCTC CAGGGGAAAGAGCCTCC CTCTCCTGCAGGGCCAGT CAGAGTGTTGGTACCTA CTTAGCCTGGTACCAAC AGAAAGTTGGCCAGCCT CCCAGGCTCCTCATCTAT GATGCGTCCAACAGGGC CACTGGCATCCCAGCCA GGTTCAGTGGCAGTGGG TCTGGGACAGACTTCACT CTCACCATCAGCAGCCT CAGACCTGAAGATTTTG CAGTTTATTACTGTCAGC AGCGTAGCAGCTGGTTC GTCACCTTCGGCCAAGG GACACCTACGGTGGAGATTA AACGTACGGTGGCTGCA CCATCTGTCTTCATCTTC CCGCCATCTGATGAGCA GTTGAAATCTGGAACTG CCTCTGTTGTGTGCCTGC TGAATAACTTCTATCCCA GAGAGGCCAAAGTACAG TGGAAGGTGGATAACGC CCTCCAATCGGTAACTC CCAGGAGAGTGTCACAG AGCAGGACAGCAAGGAC AGCACCTACAGCCTCAG CAGCACCCTGACGCTGA GCAAAGCAGACTACGAG AAACACAAAGTCTACGC CTGCGAAGTCACCCATC ANGGCCTGAGCTCGCCC GTCACAAAGAGCTTCAA CAGGGGAGAGTGNNNNA | GAGGCAGTTCAGATTTCAA CTGCTCATCAGATGGCCGGA AGATGAAGACAGATGGTGC AGCCACAGTTCGTTTAATCT CCAGTCGAGTCCCTTGGCCG AAGGTGACGAACCAGCTGC TACGCTGTGACAGTAATAA ACTGCAAAATCTTCAGGGTC TAGGCTGCTGATGGTGAGA GTGAAGTCTGTCCCAGACCC ACTGCCACTGACCTGGCTG GGATGCCAGTGGCCCTGTTG GACGCATCATAGATGAGGA GCCTGGGAGGCTGGCCAAC TTTCTGTTGGTACCAGGCTA AGTAGGTACCAACACTCTGA CTGGCCCTGCAGGAGAGG AGGCTCTTTCCCCTGGAGAC AAAGACAGGG (SEQ ID NO: 3373) | |

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | original nt sequence | sequence ID (plate/well) |
| COV57_P1 D12 | A-C036 | TACACATACGATTAGGTG ACACTATAGAATAACATCC ACTTTGCCTTTCTCCACA GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGCTACAGCAGTGGGGCG CAGGACTGTTGAAGCCTTC GGAGACCCGTGTCCCGCACC TGCGCTGTCTTTGGTGGGTC CTTCACTAATTACTACTGGA GTTGGATCCGCCAGTCCCC AGGGAAGGGGCTGGAGTGG ATTGGGAATCAATGATA GTGAATCACCAACTACAA CCCGTCCCTCAAGAGTCGA GTCACCATCTCAGTAGACA CGTCCAAGAACCAGTTCTC CCTGAGCCTGAGGTCTGTG ACCGCCGCGACACCGGCTG TGTATTACTGTGCCAGAAG GAGGTCCTTCTCTCGTCCTT CGTCTATCGACTACTGGGG CCAGGGAACCCTGGTCACC GTCTCCTCAGCGTGACCAA AGGGCCATCGGTCTTCCC CCTGAGCACCCTCCTCCAAG AGCACCTCTGGGGCACAG CGGCCTGGGCTGCCTGGT CAAGGACTACTTCCCCGAA CCTGAGCGCTCCTGA ACTCAGGCGCCCTGACCAG CGGGCTGCCACCTTCCCG GACTCTACTCCCTCAGCAG CGTGTGACCGTGCCCTCC | GCTGTGCCNNGAGGTGCTC TTGGAGGAGGGTGCCAGGG GGAAGACCGATGGGCCCTT GGTGGAGGCTGAGGAGACG GTGACCAGGGTTCCCTGGC CCCAGTAGTCGATAGACGA AGGACGAGAGAAGGACCTC CTTCTGGCACAGTAATACA CAGCCGTGTCCGCGGCGGT CACAGACCTCAGGCTCAGG GAGAACTGTTCTTGGACG TGTCTACTGAGATGTGAC TCGACTCTTGAGGGACGGG TTGTAGTTGGTGATTCCACT ATCATTGATTTCCCCAATCC ACTCCAGCCCCTTCCCTGGG GATTGGTACCTGCAGA AGTAGTAATTAGTGAAGGA CCCACCAAAGACAGCGCAG GTGCGGACAGGGTCTCCG AAGGCTTCAACAGTCCTGC GCCCCACTCTGCTAGCTGC AC (SEQ ID NO: 3375) | COV57_P1 D12 | TACCCGATTGGAGGGCGTTA TCCACCTTCCACTCGTACTTT GGCCTCTCTGGGATAGAAGT TATTCAGCAGGCACACAC AGAGGCAGTTCCAGATTTCA ACTGCTCATCAGATGGCCGG AAGATGAAGACAGATGGTG CAGCCACCAGTTCGTTTAATC TCCAGTCGTGTCCCTTGGCC GAAGGTGAGAGTTTGTAGA GCTTGCATGCAGTAATAAAC CCCAAACATCCTCAGCCTCCA CTCTGCTGATTTTCAGTGTG AAATCTGTGCCTGATCCACT GCCCCTGAACCTGTCAGGGA CCCGAAGGCCCGATTGGA ACCAAATAGATCAGGAGC TGTGGAGACTGCCCTGGCTT CTGCAGTACCAATCCAAAT AGTTGTATCCATTTCTATGC AGGAGGCTCTGACTAGACCT GCAGGAGATGGAGGCCCGC TCTCCAGGGGTGACGGGGC AGGGAG (SEQ ID NO: 3377) | COV57_P1 D12 |
| | | | AANCTTGGCGCCATGG CCCAACTTGTTTATTGCA GCTTATAATGTTACAA ATAAA (SEQ ID NO: 3372) | | | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AGCAGCTTGGGGCACCCAG ACCTACATCTGCAACGTGA ATCACAAGCCAGCAACAC CAAGGTGGACAAGAGAGTT GAGCCCAAATCTTGTGACA AAACTCACACATGCCCACC GTGCCCAGCACCTGAAC (SEQ ID NO: 3374) | | | CAGCAAGGACAGCACCT ACAGCCTCAGCAGCACC CTGACGCTGAGCAAAGC AGACTACGAGAAACACA AAGTCTACGCCTGCGAA GTCACCCATCAGGGCCT GAGCTCGCCCGTCACAA AGAGCTTCAACANGGGN ANAGTGTTAGAAGCTTG GCCGCCATGCCCCAACT TGTTTATT (SEQ ID NO: 3376) | | |
| COV57_P2 H6 | A-C037 | TACACCATATACGATTTAGGTG ACACTATAGAATAACATCC ACTTTGCCTTTCTCCCAGGTC GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGCTGCTGCAGTCTGGGC CTGAGGTGAAGAAGCCTGG GACCTCAGTGAAGTCTCC TGCAAGGCTTCTGGATTCA CCTTTACTAGCTCTGCTATG CAGTGGGTGCGACAGGCTC GTGGACAACGCCTTGAGTG GATAGGATGGTAACACAAACT GGCAGTGGTAACACAAACT ACCACAGAGAGTTCCAGGA TAGTAAAGGTGAATCCAGA AGAGTCACCATTACCAGG GACATGTCCAAGCACACAG CCTACATGGAGCTGAGCAG CTGAGACATCCAGCAG GCCCGTGTATTACTGTGCGG CCCCATATGTAGTGGTGGT ATATCGGGGCCAAGGGAC AATGTCACCGTCTCTTCAG CGTCGACCAAGGGCCCATC GGTCTTCCCCCTGGCACCCT CCTCCAAGAGCACCTCTGG GGGCACAGCAGCCCTGGGC | CGCTGTGCCCCNGAGGTGC TCCTGGAGCAGGGCGCCAG GGGGAAGACCGATGGCCAG TTGTGGAAGCTGAAGAGA CGGTGACCATTGTCCCTTGG CCCCAGATATCAAAAGCAT CATTGCAGCTACCACACT ACAATATGGGCGCACAG TAATACACCGCCGTGTCCT CGGATCTCCAGGCTGCTCAG CTCCATGTAGGCTGTGCTTG TGGACATGTCCCTGTAAT GGTGACTCTTTCTGGAACT TCTGTGCGTAGTTTGTGTTA CCACTGCCACACGATCC ATCCTATCCACTCAAGGCG TTGTCCACGAGCCTGCGC ACCACTGGTAACACAAACT TAGTAAAGGTGAATCCAGA AGCCTTGCAGGAGACCTTC ACTGAGGTCCCAGGCTTCTT CACCTCAGGCCCCAGACTGC NC (SEQ ID NO: 3379) | COV57_P2 H6 | TACACATACGATTTAGGT GACACTATAGAATAACA TCCACTTTGCCTTTCTCT CCAGAGGTGTCCACTCCC AGGTCCAACTGCACCTC GGTTCTATCGATTGAATT CCACCATGGGATGGTCA TGTATCATCCTTTTTCTA GTAGCAACTGCAACGG GTACAACTGCAAGTGT TGTACATTCAGAAATTGT GTTGACGCAGTCTCCAG GCACCCTGTCTTTGTCTC CAGGGGAAAGAGCCACC CTCTCCTGCAGGGCCAGT CAGATGTTAGCAGCAG CTACTTAGCCTGGTACCA GCAGAAACCTGGCCAGG CTCCCAGGCTCCTCATCT ATGGTCATCCAGCAGG GCCACTGGGCATCCCAGA CAGTTCAGTGGCAGTG ACTCTGGGACAGACTTC ACTCTCACCATCAGCAG TTGCAGTGTATTACTGTC AGCAGTGTACGGTAGCTCA CCGTGACGTTCGGCCA AGGGACCAAGGTGGAAA TCAAACGTACGGTGCT GCACCATCTGTCTTCATC TTCCCGCCATCTGATGAG CAGTTGAAATCTGGAAC | ATTGGAGGGCGTTATCCACC TTCCACTGTACTTTGGCCTC TCTGGGATAGNNCNTAANN CAGCAGGCACCACAACAGAG GCAGTTCCAGATTTCAACTG CTCATCAGATGCGGGAAG ATGAAGACAGATGGTGCAG CCACAGTTCGTTGATTTCC ACCTTGGTCCCTTGGCCGAA CGTCCACGGTGAGCTACCAT ACTGCTGACAGTAATAACAT GCAAAATCTTCAGGCTCCAG TCTGCTGATGGTGAGAGTGA AGTCGTCCCAGACCCACTG CACTGAACCTGTCTGGGAT GCCAGTGCCCTGCTGGATG CACCATAGATAGGAGGCCT GGGAGCCTGGCCAGGTTTCT GCTGGTACCAAGGCTAAGTA GCTGCTGCTAACACTCTGAC TGGCCCTGCAGGAGAGGGT GGCTCTTTTCCCCTGGAGACA AAGACAGGGNGANTGNAGA NTGGGTC (SEQ ID NO: 3381) | COV57_P2 H6 |

TABLE 15-continued

Additional sequence information for the disclosed anti-SARS-CoV-2 antibodies

| ALICE | AbsID | HEAVY CHAIN ||| LIGHT CHAIN |||
|---|---|---|---|---|---|---|---|
| | | miniprep sequence | original nt sequence | sequence ID (plate/well) | miniprep sequence | original nt sequence | sequence ID (plate/well) |
| | | TGCCTGGTCAAGGACTACT TCCCCGAACCTGTGACGGT CTCGTGGAACTCCAGCGCC CTGACCAGCGGCGTGCACA CCTTCCCGGCTGTCCTACAG TCCTCAGGACTCTACTCCCT CAGCAGCGTGGTGACCGTG CCCTCCAGCAGCTTGGGCA CCCAGACCTACATCTGCAA CGTGAATCACAAGCCCAGC AACACCAAGGTGGACAAG AGAGTTGAGCCCAAATCTT GTGACAAACTCACACATG CCCACCGTGCC (SEQ ID NO: 3378) | | | | | |
| COV57_P1 E9 | A-C038 | TACACATACGATTTAGGTG ACACTATAGAATAACATCC ACTTTGCCTTTCTCTCCACA GGTGTCCACTCCCAGGTCC AACTGCACCTCGGTTCTATC GATTGAATTCCACCATGGG ATGGTCATGTATCATCCTTT TTCTAGTAGCAACTCGAAC CGGTGTACATTCTGAGGTG CAGCTGGTGGAGTCTGGGG GAGGCGTGGTCCAGCCTGG GAGGTCCCTGAGACTCTCC TGTGCAGCCTCTGGATTCAC CTTCAATAGAATTGCCATGT ACTGGGTCCGCCAGGCTCC AGGCAAGGGGCTGGAATGG GTGGCAGTTATATCATTGA TGGAAGTTATGAATACTAT GCAGAGTCCGTGAAGGGCC GGTTCGCCATCTCCAGAGA CAATTCCAAGAACACGCTG TATCTACAGATGAACAGCC TGAGAGGTGAGGACACGGC CCACCAMANCTGCAC TGTCTATTACTTGGTGGCAAAA | CTGTGCTCTCGGANGTGCTC CTGGAGCAGGCGATGGGGG GGAAGACCGATGGGCCTT GGTGGAGGCTGAGAGACG GTGACCAGGGTTCCCTGGC CCCAGGAGTCAGGATAGCA TACACATTAGCTATCATTGC CCCATCGACTTTCGCACA GTAATAGACACCGTGTCC TCAGCTCTCCAGGCTGTTCAT CTGTAGATACAGCGTGTTCT TGGAATTGTCTCTGAGAT GGCGAACCGGCCCTTCACG GATCTGCATAGTATTCATA ACTTCCATCAAATGATATA ACTGCCACCCATTCCAGCC CCTTGCCTGAGCCTGGCG GTGCCAGTACATGGCAATT CTATTGAAGGTGAATCCAG AGGCTGCACAGGAGAGTCT CAGGGACCTCCCAGGCTGG ACCACGCCCCCCAGACT CCACCANNCTGCAC (SEQ ID NO: 3383) | COV57_P1 E9 | TACACATACGATTTAGGT GACACTATAGAATAACA TCCACTTTGCCTTTCTCT CCACAGGTGTCCACTCCC AGTTCCAACTGCACCTC GGTTCTATCGATTGAATT CCACCATGGGATGGTCA TGTATCATCCTTTTTCTA GTAGCAACTCGAACCGG GTACAACTGCAACCCGG TTCTTGGCCAATTTTAT GCTGATCAGCCCCACTC TGTGTCGGAGTCTCCGG GAAGACGGTTACCATC TCCTGCACCGCAGCAG TGGCAGCAATTGCCACCA ACTATGTGCAGTGGTAC CAGCAGCGCCGGGCAG TGCCCCCACCACTGTGAT CTATGAAGATACCCAAA GACCCTCTGGGTCCCTG ATCGGTTCTCTGGCTCCA TCGACAGCTCCTCAATT CTGCCTCCTCCACCATCT CTGGACTGAAGACTGAG | TGGGGGCTGCTTAGGACCGTC AGCTTGGTCCCCTCCGCCGAA CACCAACGACTGTTGATAT CATAAGACTGACAGTAGTA GTCAGCCTCGTCCTCCAGCTCT TCAGTCCAGAGATGGTGAG GGAGGCAGAATTGGAGGAG CTGTCGATGGAGCCAGAGA ACCGATCAGGGACCCCAGA GGGTCTTTGGGTATCTTCAT AGATCACGTGGTGGGGGC ACTGCCCCGGCCGTGCTGT ACCACTGCACATAGTTGCTG GCAATGCTGCCACTGCTGCC GGTGCAGGAGATGGTAACC GTCTTCCCGGAGACTCCGA CACAGAGTGGGCTGAGTC AACAGACTGGGACCAGG AACCGGNTG (SEQ ID NO: 3385) | COV57_P1 E9 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AGTCCGATGGGTTATTGCA CTAATGGTGTATGCTATCCT GACTCCTGGGCCAGGAA CCCTGTCACCGTCTCCTCA GCGTCGACCAAGGGCCCAT CGGTCTTCCCCCTGGCACCC TCCTCCAAGAGCACCTCTG GGGGCACAGCGGCCCTGGG CTGCCTGGTCAAGGACTAC TTCCCCGAACCTGTGACGG TCTCGTGGAACTCAGGCGC CCTGACCAGCGGCGTGCAC ACCTTCCCGGCTGTCCTACA GTCCTCAGGACTCTACTCCC TCAGCAGCGTGGTGACCGT GCCCTCCAGCAGCTTGGGC ACCCAGACCTACATCTGCA ACGTGAATCACAAGCCCAG CAACACCNANGTGGACAAG AGAGTTGAGCCCAAATCTT GTGACAAAACTCACACATG CCCACCGTGCCCA (SEQ ID NO: 3382) | | | GACGAGGCTGACTACTA CTGTCAGTCTTATGATAT CAACAGTCGTTGGGTGTT CGGCGGAGGGACCAAGC TGACCGTCCTAAGCCAG CCCAAGGCTGCCCCCTC GGTCACTCTGTTCCCACC CTCGAGTGAGGAGCTTC AAGCAACAAGGCCACA CTGGTGTGTCTCATAAGT GACTTCTACCCGGGAGC CGTGACAGTGGCCTGGA AGGCAGATAGCAGCCCC GTCAAGGCGGGAGTGGA GACCACCACACCCTCCA AACAAAGCAACAACAAG TACGGGCCAGCAGCTA CCTGAGCCTGACGCCTG AGCAGTGGAAGTCCCAC AGAAGCTACAGCTGCCA GGTCACGCATGAAGGGA GCACCGTGGAGAACA GTGGCCCTACAGAATG TTCATAGAAGCTTGGC CGCCATGGCCCAACTTGT TTATTGCAGTTATAATG G (SEQ ID NO: 3384) | | |
| COV57_P1 F10 | A-C039 | TACACCATACGATTTAGGT ACACTATAGAATACATCC ACTTTGCCTTTCTCTCCACA GGTGTCCACTCCCACCCC AACTGCACCTCGGTTCTATC GATTGAATTCCACCATGGG ATGGTCATGTATCATCCTTT TTCTAGTAGCAACTCCAAA CGGTGTACATTCCCAGGTG CAGCTACAGCAGTGGGGCG CGGTCACAGACCTTCTTG GGAGACCCGTGTCCCCACC TGCGCTGTCTATGGTGGGTC CTTCAGTGGTTACTACTGGA GACTGCACTTCTTGAGGGA CGGGGTGTAGTTGGGTCTTC GCTGGATCCGCCAGCCCC AGGGAAGGGCTGGAGTGG ATTGGGAAATCAATCATA | | COV57_P1 F10 | TACACCATACGATTTAGGT GACATATAGAATAACA TCCACTTTGCCTTTCTCT CCACAGGTGTCCACTCCC AGTTCCAACTGCACCTC GGTTCTATCGATTGAATT CCACCATGGGATGGTCA TGTATCATCCTTTTCTA GTAGCAACTCCAAA GTAGCAACTGCAACCGG TTCCTGGCCCAGTCTGT GCTGACTCAGCCGCCTC AGTGTCCACTGGGAGCCA GGCAGAGGGTCACCATC TCCTGCACTGGGAGCAA GTTATGATGTACACTGGT ACCAGCAGCTTCCAGGA | TTTGGGCTGACCTAGGACGGT CAGCTTGGTCCCTCCGCCAA ACACCCTCGAACCACTCAGG CTGCTGTCATAGGACTGCA GTAATAATCAGCCTCATCCT CAGCCTGGAGCCCAGTGAT GCCCAGGAGCTGAGGTG CCAGACTGAGCCAGAGA ATCGGTCAGGAGCCCCTGA GGGCCGATTGCTGTTACCAT AGATGAGAGTTTGGGGGC TGTTCTGGAAGCTGCTGTT ACCAGTGTACATCATAACCT GCCCCGATGTTGGAGTTGCT CCCAGTCCAGGAGATGGTG GTTATGATGTACACTGGT ACCAGCAGCTTCCAGGA | COV57_P1 F10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| CO57_P2 A10 | | TACACATACGATTTAGGTG ACACTATAGAATAACATCC ACTTTGCCTTTCTCCACA GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCTGAGGTG (SEQ ID NO: 3386) | TGGGGGCTGCCGGATCCAG CTCCAGTAGTAACCACTGA AGGACCACCATAGACAGC GCAGGTGAGGGACCAGGGTC TCCGAAGGCTTCAACAGTC CTGAAGCTGAGCTCTGTG ACCGCCGCGACACGGCTG TGTATTACTGTGCGAGAGC TGGTTTTGGAGTGGTTATTA CCTATGGTTCAGGAACGGA TCCCCTTTTTGACTACTGGG GCCAGGGAACCCTGGTCAC CGTCTCCTCAGCGTCGACC AAGGGCCATCGGTCTTCC CCCTGGCACCCTCCTCCAA GAGCACCTCTGGGGGCACA GCGGCCCTGGGCTGCCTGG TCAAGGACTACTTCCCCGA ACCTGTGACGGTCTCGTGG AACTCAGGCGCCCTGACCA GCGGCGTGCACACCTTCCC GGCTGTCCTACAGTCCTCA GGACTCTACTCCCTCAGCA GCGTGGTGACCGTGCCCTC CAGCAGCTTGGGCACCCAG ACCTACATCTGCAACGTGA ATCACAAGCCCAGCAACAC CAAGGTGGACAAGAGAGTT GAGCCCAAATCTTGTGACA AAACTCACACATGCCCAC (SEQ ID NO: 3387) | | ACAGCCCCAAACTCCT CATCTATGGTAACAGCA ATCGGCCCTCAGGGGTC CCTGACCGATTCTCTGGC TCCAAGTCTGGCACCTCA GCCTCCCTGGCCATCACT GGGCTCCAGGCTGAGGA TGAGGCTGATTATTACTG CCAGTCCTATGACAGCA GCCTGAGTGGTTCGAGG GTGTTGGCGGAGGGAC CAAGCTGACCGTCCTAG GTCAGCCCAAGGCTGCC CCCTCGGTCACTCTGTTC CCGCCCTCGAGTGAGGA GCTTCAAGCCAACAAGG CCACACTGGTGTGTCTCA TAAGTGACTTCTACCCGG GAGCCGTGACAGTGGCC TGGAAGGCAGATAGCAG CCCCGTCAAGGCGGGAG TGGAGACCACCAAGCCAC TCCAAACAAGCAACAA CAAGTACGCGGCCAGCA GCTACCTGAGCCTGACG CCTGAGCAGTGGAAGTC CCAGGTCACGCATGAA GGGAGCACCGTGGAGAA GACAGTGGCCCCTACAG AATGTTCATAGAAGCTT GGCCGCCATGGCCCAAC TTGTTTATTGCAGCTTAT AATGGTTACAAATAAA (SEQ ID NO: 3388) | GTCAGCACAGACTGGGACC AGGAACCGGNTG (SEQ ID NO: 3389) | CO57_P2 A10 |
| A-C040 | | CGCTGTGNNNNNGAGGTGC TCTTTGGAGGAGGGTGCCAG GGGGAAGACCGATGGGCCC TTGGTGCCACTCCGAGGAGA CGGTGACCGTGGTCCCTTTG CCCCAGACGTCCATGTAGT AGTAGTAAAAATGGGCA GCTGGTACTACTACAATGG GGATCTGTGTACAGTAAT | | CO57_P2 A10 | TACACATACGATTAGGT GACACTATAGAATAACA TCCACTTTGCCTTTCTCT CCACAGGTCCACTACTA ATATCCCCACCACCTGACAGTA CTATCCCACCACCTGACAGTA ATAGTCGGCCTCATCCCGG CTTCGACCCTGCTGATGGTC AGGGTGGCCGTGTTCCAGA GTTGGAGCCAGAGAATCGC TCAGGGATCCCTGAGGCC | TTGGGCTGACCTAGGACGGT CAGCTTGGTCCCTCCGCCGA ATACCCCTGATCACTACTA CTATCCACCACCTGACAGTA ATAGTCGGCCTCATCCCGG CTTCGACCCTGCTGATGGTC AGGGTGGCCGTGTTCCAGA GTTGGAGCCAGAGAATCGC TCAGGGATCCCTGAGGCC | CO57_P2 A10 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | CAGTTGGTGGAGTCTGGGG GAGGCTTGGTAAAGCCTGG GGGCTCCCTTAGACTCTCCT GTGCAGCCTCTGGATTCACT TTCAGTAACGCCTGATGA GCTGGGTCCGCCAGGCTCC AGGGAAGGGGCTGGAGTGG GTTGGCCGTATTAAAAGCA AAACTGATGGTGGGACAAC AGACTACGCTGCACCCGTG AAAGGCAGATTCACCATCT CAAGAGATGATTCAAAAAA CACGCTGTATCTGCAAATG AACAGCCTGAAAACCGAGG ACACAGCCGTGTATTACTG TACCACAGATCCCCATTGT AGTAGTACCAGCTGCCCCA TTTTTTACTACTACTACATG GACGTCTGGGGCAAAGGGA CCACGGTCACCGTCTCCTCA GCGTCGACCAAGGGCCCAT CGGTCTTCCCCCTGGCACCC TCCTCCAAGAGCACCTCTG GGGGC₄C₄GCGGCCCTGGG CTGCCTGGTCAAGGACTAC TTCCCCGAACCTGTGACGG TCTCGTGGAACTCAGGCGC CCTGACCAGCGGCGTGCAC ACCTTCCCGGCTGTCCTACA GTCCTCANGACTCTACTCCC TCAGCAGCGTGGTGACCGT GCCCTCCAGCAGCTTGGGC ACCCAGACCTACATCTGCA ACGTGAATCACAAGCCCAG CAACACCNANGTGGACAAG AGAGTTGAGCCCAAATCTT GTGACAAAAC (SEQ ID NO: 3390) | ACACGGCTGTGTCCTCGGTT TTCAGGCTGTTCATTTGCAG ATACAGCGTGTTTTTTGAAT TCTGCCTTTCACGGGTGCAG CGTAGTCTGTTGTCCCACCA TCAGTTTGCTTTTAATACG GCCAACCCACTCCAGCCCC TTCCCTGGAGCCTGGCGGA CCCAGCTCATCCAGCGTT ACTGAAAGTGAATCCAGAG GCTGCACAGGAGAGTCTAA GGGACCCCCCAGGCTTTAC CAAGCCTCCCCAGACTCC NNNNCTGCACC (SEQ ID NO: 3391) | | TTCTGTGACCTCCTATGA GCTGACTCAGCCACCCTC GGTGTCAGTGTCCCCAG GACAGACGGCCAGGATT ACCTGTGGGGGAAACAA CATTGGAAGTAAAAGTG TGCACTGGTACCAGCAG AAGCCAGGCCAGGCCCC TGTGCTGGTCGTCTATGA TGATAGCGACCGGCCCT CAGGGATCCCTGAGCGA TTCTCTGGCTCCAACTCT GGGAACACGGCCACCTCT GACCATCAGCAGGGTCG AAGCCGGGATGAGGCC GACTATTACTGTCAGGTG TGGGATAGTAGTAGTGA TCAGGGGGTATTCGGCG GAGGGACCAAGCTGACC GTCCTAGGTCAGCCCAA GGCTGCCCCCTCCGGTCAC TCTGTTCCCGCCCTCGAG TGAGGAGCTTCAAGCCA ACAAGGCCACACTGGTG TGTCTCATAAGTGACTTC TACCCGGGAGCCGTGAC AGTGGCCTGGAAGGCAG ATAGCCCCCGTCAAG GCGGGAGTGGAGACCAC CACACCCTCCAAACAAA GCAACAACAAGTACGCG GCCAGCAGCTACCTGAG CCTGACGCCTGAGCAGT GGAAGTCCCACAGAAGC CACAGCTGCCAGTCAC GCATGAAGGGAGCCACCG TGGAGAAGACAGTGCC CCTACAGAATGTTCATA GAAGCTTGGCCGCCATG GCCCAACTTGTTTATTGC AGCTTATAATGGTTACA AATAAAG (SEQ ID NO: 3392) | GGTCGCTATCATCATAGACG ACCAGCACAGGGGCCTGGC CTGGCTTCGTCGTGTACCAG TGCACACTTTTACTTCCAAT gtgtttccccAcAgtAA TCCTGGCCGTCTGTCCTGGG GCCACTGACACCGAGGGTG GCTGAGTCAGCACCATACTGG GACCAGGAACCGGTTG (SEQ ID NO: 3393) | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| C057_P1 B9 | A-C041 | TACACATACGATTTAGGTG ACACTATAGAATAACATCC ACTTTGCCTTTCTCTCCACA GGTGTCCACTTCCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGCTACAGAGTGGGCG CAGGACTGTTGAAGCCTTC GGAGACCCTGTCCCTCACC TGCGCTGTCTTATGGTGGGTC CTTCAGTGGTTACTACTGGA GCTGGATCCGCCAGCCCC AGGGAAGGGGCTGGAGTGG ATTGGGGAAGTCAATCATA GTGGAAGCACCAACTACAA CCCGTCCCTCAAGAGTCGA GTCACCATATCAGTAGACA CGTCCAAGAACCAGTTCTT CCTGAAGCTGAGCTCTGTG ACCGCGGACACGGCTGTG TGTATTACTGTGCGAGACA CTGATGCCGAGGACTAC TACTACGGTATGGACG TCTGGGGCCAAGGGACCAC GGTCACCGTCTCCTCAGCGT CGACCAAGGGCCCATCGGT CTTCCCCCTGGCACCCTCCT CCAAGAGCACCTCTGGGG CACAGCGCCCTGGGCTGC CTGGTCAAGGACTACTTCC CCGAACCTGTGACGGTCTC GTGGAACTCNGCGCCCTGA CCAGCGGCGTGCACACCTT CCCGGCTGTCCTACAGTCCT CANGACTCTACTCCCTCAG CAGCTGGTGACCGTGCCC TCCAGCAGCTTGGGCACCC AGACCTACATCTGCAACGT ACCNANGTGGACAAGANAG TTGAGCCCAAATCTTGTGA | GNCGCTGTGNNNNNNAAGT GCTCTTGGAGGAGGGTGCC AGGGGAAGACCGATGGGC CCTTGGTGGAGGCTGAAGGA GACGTGACCGTGGTCCCT TGGCCCAGACGTCCATAC CGTAGTAGTAGTAGTCCCT CGGCATCCAGTGTCTCGCA CAGTAATACACAGCCGTGT CCGCGGCGGTCACAGAGCT CAGCTTCAGGAAGAACTGG TTCTTGGACGTGTCTACTGA TATGGTGACTCGACTCTTGA TTCAGTGGTTGTAGTTGGT GGGACGGGTTGTAGTTGGT GCTTCCACTATGATTGACTT CCCAATCCACTCCAGCCC CTTCCCTGGGGCTGGCG ATCCAGCTCCAGTAGTAAC CACTGAAGGACCCACCATA GACAGCGCAGGTGAGGGAC AGGGTTCTCGAAGGCTTCA ACAGTCCTGCGCCCACTG CTGTAGCTGCACCTNNAA (SEQ ID NO: 3395) | C057_P1 B9 | TACACATACGATTTAGGTT GACCATATAGAATAACA TCCACTTTGCCTTTCTCT CCACAGGTGTCCACTCCC AGTTCCAACTGCACCTC GGTTCTATCGATTGAATT CCACCATGGAGTGCAA TGTATCATCCTTTTTCTA GTAGCAACTGCAACCGG TGTACAAGACAATCCA GTTGACCCAGTCTCCATC CTCCCTGTCTGCATCTGT AGGAGACAGAGTCACCA TCACTTGCCGGGCAAGT CAGAGCATTAGCAGTA TTTAAATTGGTATCAGCA GAAACCAGGGAAAGCCC CTAAGCTCCTGATCTATG CTGCATCCAGTTTGCAAA GTGGGGTCCCATCAAGG TTCAGTGGCAGTGGATCT GGGACAGATTTCACTCTC ACCATCAGCAGTCTGCAA CCTGAAGATTTTGCAA GTTACTACTGTCAACAGA GTTACAGTACCCCTCGG ACGTTCGGCCAAGGGAC CAAGGTGGAAATCAAAG TACGGTGGCTGCACCAT CTGTCTTCATCTTCCCGC CATCTGATGAGCAGTTG AAATCTGGAACTGCCTCT GTTGTGTGCCTGCTGAAT AACTTCTATCCCAGAGA GGCCAAAGTACAGTGGA AGGTGGATAACGCCCTC CAATCGGGTAACTCCCA AGGACAGCAAGGACAGC ACCTACAGCCTCAGCAG CACCCTGACGCTGAGCA AAGCAGACTACGAGAAA CACAAAGTCTACGCCTG CGAAGTCACCCATCAGG | GANTTNCCGATTGAGGG CGTTATCCACCTTCCACTGT ACTTTGGCCTCTCTGGATA GAAGTTATTCAGCAGGCAC ACAACAGGCAGTTCAG ATTTCAACTGCTCATCAGAT GGCGGAAGATGAAGACAG ATGGTGCAGCCACCAGTTCGT TTGATTTCCACCTTGGTCCC TTGGCCGAACGTCCAGGG GTACTGTAACTCTGTTGACA GTAGTAAGTTGCAAAATCTT CAGGTTCCAGACTGCTGATG GTGAGAGTGAAATCTGTCCC AGATCCACTGCCACTGAACC TTGATGGGACCCCCACTTTGC AAACTGGATGCAGCATAGA TCAGGAGCTTAGGGGCTTTC CCTGGTTTCTGCTGATACCA ATTTAAATAGCTGCTAATGC TCTGACTTGCCCGGCAAGTG ATGGTGCCTCTGTCTCCTAC AGATGCAGACAGGAG (SEQ ID NO: 3397) | C057_P1 B9 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | CAAACTCACACATGCCCAC CGTGCCCAG (SEQ ID NO: 3394) | | | | GCCTGAGCTCGCCCGTC ACAAAGAGCTTCAACAG GGGAGAGTGTTAGAAGC TTGGNCGCCATGGCCCA ACTTGTTTATTGCAGCTT ATAATGGTTACAAATAA AGCAATAGACATCAC (SEQ ID NO: 3396) | |
| V-C001 | | NNNNNNNNNNGTATCA TACACATACGATTAGGTG ACACTATAGAATAACATCC ACTTTGCCTTTCTCTCCACA GGTGTCCACTCCCAGGTCC AACTGCCACCTGCGGTTCTATC GATTGAATTCCACCATGGG ATGGTCATGTATCATCCTTT TTCTAGTAGCAACTGCAAC CGGTGTACATTCTCAGGTG CAGCTGGTGGAGTCTGGAG GAGGCTTGATCCAGCCTGG GGGTCCCTGAGACTCTCC TGTGCAGCCTCTGGTTCAT CGTCAGTAGCAACTACATG AGCTGGGTCCGCCAGGCTC CAGGGAAGGGCTGAGTG GGTCTCAGTTATTTATAGCG GTGGTAGCACATTCTACAC AGACTCCGTGAAGGGCCGA TTCACCATCTCCAGAGACA ATTCCAAGAACACTCTGTA TCTTCAAATGAACAGCCTG AGAGCCGAGGACACGGCCG TGTATTACTGTGTGCGGGA CTACGGTGACTTCTACTTTG ACTACTGGGGCCAGGGAAC CCTGGTCACCGTCTCCTCAG CGTCGACCAAGGGCCCATC CCTCCAAGAGCACCTCTGG GGGCACAGGCGGCCCTGGC TGCCTGGTCAAGGACTACT TCCCCGAACCTGTGACGGT CTCTGGAACTTCAGGCGCC CTGACCAGCGGCGTGCACA | GAGGTGCAGCTGGTGGAGT CTGGAGGAGGCTTGATCCA GCCTGGGGGGTCCCTGAGA CTCTCCTGTGCAGCCTCTGG GTTCATCGTCAGTAGCAAC TACATGAGCTGGGTCCGCC AGGCTCCAGGGAAGGGCT GAGTGGGTCTCAGTTATT TATAGCGGTGGTAGCACATT CTACACAGACTCCGTGAAG GGCCGATTCACCATCTCCA GAGACAATTCCAAGAACAC TCTGTATCTTCAAATGAACA GCCTGAGAGCCGAGGACAC GGCCGTGTATTACTGTGTGC GGGACTACGGTGACTTCTA CTTTGACTACTGGGGCCAG GGAACCCTGGTCACCGTCT CCTCAG (SEQ ID NO: 3399) | COV107_P2_H9 | NNNNNNNCNNATGTATC NTACACATACGATTTAG GTGACACTATAGAATAA CATCCACTTTGCCTTTCT CTCCACAGGTGTCCACTC CCAGGTCCAACTGCCACC TCGGTTCTATCGATTGAA TTCCACCATGGGATGGTC ATGTATCATCCTTTTCT AGTAGCAACTGCAACCG GTGTACATTCAGAAATT GTTGACCGACAGTCTCCA GGCACCCTGTCTTTGTCT CCAGGGAAAGAGCCAC CCTCTCCTGCAGGGCA GTCAGAGTGTTAGCAGC AGTACTTAGCCTGGTAC CAGCAGAAACCTGGCCA GGCTCCCAGGCTCCTCAT CTATGGTGCATCCAGCA GGGCCACTGGCATCCCA GACAGGTTCAGTGGCCG TGGGTCTGAGACAGACT TCACTCTCACCATCAGCA GACTGGAGCCTGAAGAT TGTGCAGTGTATTACTGT CAGCAGTATGGTAGCTC ACCCCGGACGTTCGGCC AAGGGACCAAGGTGGAA ATCAAACGTACGGTGGC TGCACCATCTGTCTTCAT CTTCCCGCCATCTGATGA GCAGTTGAAATCTGGAA CTGCCTCTGTTGTGTGCC TGCTGAATAACTTCTATC CCAGAGAGGCCAAAGTA | GAAATTGTTGACGCAGTC TCCAGGCACCCTGTCTTTGT CTCCAGGGAAAGAGCCAC CCTCTCCTGCAGGGCCAGTC AGAGTGTTAGCAGCAGTA CTTAGCCTGGTACCAGCAGA AACCTGGCCAGGCTCCCAG GCTCCTCATCTATGGTGCAT CCAGCAGGGCCACTGGCAT CCCAGACAGGTTCAGTGGC GGTGGGTCTGAGACAGACTT CACTCTCACCATCAGCAGAC TGGAGCCTGAAGATTGTGCA GTGTATTACTGTCAGCAGTA TGGTAGCTCACCCCGGACGT TCGGCCAAGGGACCAAGGT GAAATCAAAC (SEQ ID NO: 3401) | COV107_P2_H9 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | CCTTCCCGGCTGTCCTACAG TCCTCAGGACTCTACTCCCT CAGCAGCGTGGTGACCGTG CCCTCCAGCAGCTTGGGCA CCCAGACCTACATCTGCAA CGTGAATCACAAGCCCAGC AACACCNANNTGGACAAGA GAGTTGAGCCCAAATCTTG TGACAAAACTCACACATGC CCACCGTGCCCAGCACCTG AACTCCTGGGGGGACCGTC AGTCTTCCTCTTCCCCCCAA AACCCNAGGACACCCTCAT GATCTCCCNGACCCCNGAG TCACATGCGTGGNNGTGGN NGTGANCCACGAAGANCCT GAGGTCAAGTTCAACTGGN ACNNNGNNNNGNN (SEQ ID NO: 3398) | | | CAGTGGAAGGTGGATAA CGCCCTCCAATCGGGTA ACTCCCAGGAGAGTGTC ACAGAGCAGGACAGCAA GGACAGCACCTACAGCC TCAGCAGCACCCTGACG CTGAGCAAAGCAGACTA CGAGAAACACAAAGTCT ACGCCTGCGAAGTCACC CATCNGGNCNTGAGCTC GCCCGTCACAAAGAGCT TCAACAGGGGAGAGTGT TAGAAGCTTGGCCGCCA TGGCCCAACTTGTTTATT GCAGCTTATAATGGTTAC AAATAAAGCAATAGCAT CACAAATTTCACAAATA AAGCATTTTTTTCACTGC ATTCTANTTGNNGTTNGT CCAAACTCATCANGTAT NTNNCATGTCTGGNTCG GGANTNNNGCGCAGCNC NTGCTGAANNNACNTCT GAANNAGANNNNGTTAG GTACCTTNNGNNNGNNN NNNN (SEQ ID NO: 3400) | | |
| | V-C002 | NNNNNNNNNNNTNTGNNTC NTACNCATACGATTTAGGT GACACTATAGAATAACATC CACTTTGCCTTTCTCTCCAC AGGTGTCCACTCCCAGGTC CAACTGCACCTCGGTTCTAT CGATTGAATTCCACCATGG GATGGTCATGTATCATCCTT TTTCTAGTAGCAACTGCAA CCGGTGTACATTCTCAGGT GCAGCTGGTGGAGTCTGGA GGAGGCTTGATCCAGCCTG GGGGGTCCCTGAGACTCTC CTGTGCAGCCTCTGGGTTCA TCGTCAGTAGCAACTACAT | GAGGTGCAGCTGGTGGAGT CTGGAGGAGGCTTGATCCA GCCTGGGGGGTCCCTGAGA CTCTCCTGTGCAGCCTCTGG GTTCATCGTCAGTAGCAAC TACATGAGCTGGGTCCGCC AGGCTCCAGGGAAGGGGCT GGAGTGGGTCTCAGTTATTT ATAGCGGTGGTAGCACATT CTACGCAGACTCCGTGAAG GGCCGATTCACCATCTCCA GAGACAATTCCAAGAACAC GCTGTATCTTCAAATGAAC AGCCTGAGAGCCGAGGACA CGGCCGTGTATTACTGTGC | COV107_ P2_b1 | NNNNNNNCNTATGTATC NTACACATACGATTTAG GTGACACTATAGAATAA CATCCACTTTGCCTTTCT CTCCACAGGTGTCCACTC CCAGGTCCAACTGCACC TCGGTTCTATCGATTGAA TTCCACCATGGGATGGTC ATGTATCATCCTTTTTCT AGTAGCAACTGCAACCG GTGTACATTCAGAAATT GTGTTGACGCAGTCTCCA GGCACCCTGTCTTTGTCT CCAGGGGAAAGAGCCAC CCTCTCCTGCAGGGCCA | GAAATTGTGTTGACGCAGTC TCCAGGCACCCTGTCTTTGT CTCCAGGGGAAAGAGCCAC CCTCTCCTGCAGGGCCAGTC AGAGTGTTAGCAGCAGCTA CTTAGCCTGGTACCAGCAGA AACCTGGCCAGGCTCCCAG GCTCCTCATCTATGGTGCAT CCAGCAGGGCCACTGGCAT CCCAGACAGGTTCAGTGGC AGTGGGTCTGGGACAGACTT CACTCTCACCATCAGCAGAC TGGAGCCTGAAGATTTTGCA GTCTATTACTGTCAGCAGTA TGGTAGCTCACCTCGGACGT | COV107_ P2_b1 |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | original nt sequence | sequence ID (plate/well) |
| | GAGTGGGTCCGGCAGCT CCAGGGAAGGGGCTGGAGT GGGTCTCAGTTATTTATAGC GGTGGTAGCACATTCTACG CAGACTCCGTGAAGGGCCG ATTCACCATCTCCAGAGAC AATTCCAAGAACACAGCTGT ATCTTCAAATGAACAGCCT GAGAGCCGAGGACACGGCC GTGTATTACTGTGCGAGGG ACTACGGTGACTACTACTTT GACTACTGGGGCCAGGGAA CCCTGGTCACCGTCTCCTCA GCGTCGACCAAGGGCCCAT CGGTCTTCCCCCTGGCACCC TCCTCCAAGAGCACCTCTG GGGGCACAGCGGCCCTGGG CTGCCTGGTCAAGGACTAC TTCCCCGAACCTGTGACGG TCTCGTGGAACTCAGGCGC CCTGACCAGCGGCGTGCAC ACCTTCCCGGCTGTCCTACA GTCCTCAGGACTCTACTCCC TCAGCAGCGTGGTGACCGT GCCCTCCAGCAGCTTGGGC ACCCAGACCTACATCTGCA ACGTGAATCACAAGCCCAG CAACACCAAGGTGGACAAG AGAGTTGAGCCCAAATCTT GTGACAAACTCACACATG CCCACCGTGCCCAGCACCT GAACTCCTGGGGGGACCGT CAGTCTTCCTCTTCCCCCCA AAACCCAANGACACCCCTCA TGATCTCCCGGACCCCTGA GGTCACATGCGTGGTGTG GACGTGAGCCACGAANANC CTGANNCAAGTTCNACTGG NACGTTGGNNGGCGTNNNGT GCATANGCCANANAAGCNG CGGAGGAGCANTANANAGC ACGTACGNNNNGNCNNNGAC CCNNNNCNNCNGCNNNGAG TNNNNANNNNNNNANAN NNCAGNCTCANAANCNNNC | GAGGGACTACGGTGACTAC TACTTTGACTACTGGGGCC AGGGAACCCTGGTCACCGT CTCCTCAG (SEQ ID NO: 3403) | | TCGGCCAAGGGACCAAGT GGAAATCAAAC (SEQ ID NO: 3405) | |
| | GTCAGAGTGTTAGCAGC AGTACTTAGCCTGGTAC CAGCAGAAACCTGGCCA GGCTCCCAGGCTCCTCAT CTATGGTGCATCCAGCA GGGCCACTGCCATCCCA GACAGGTTCAGTGGCAG TGGGTCTGGGACAGACT TCACTCTCACCATCAGCA GACTGGAGCCTGAAGAT TTTGCAGTCTATTACTGT CAGCAGTATGSTAGCTC ACCTCGGACGTTCGGCC AAGGGACCAAGGTGGAA ATCAAACGTACGGTGGC TGCACCATCTGTCTTCAT CTTCCCGCCATCTGATGA GCAGTTGAAATCTGGAA CTGCCTCTGTTGTGTGCC TGCTGAATAACTTCTATC CCAGAGAGGCCAAAGTA CAGTGGAAGGTGGATAA CGCCCTCCAATCGGGTA ACTCCCAGGAGAGTGTC ACAGAGCAGGACAGCAA GGACAGCACCTACAGCC TCAGCAGCACCCTGACG CTGAGCAAAGCAGACTA CGAGAAACAACAAAGTCT ACGCCTGCGAAGTCACC CATCNGGNCCTGAGCTC GCCCGTCACAAAGAGCT TCAACAGGGGAGAGTGT TAGAAGCTTGGCCGCCA TGGNCCAACTTGTTTATT GCAGCTTATAATGGNTA CAAATAAAGCAATAGCA TCACAAATTTCACAAAT AAAGCATTTTTTTCACTG CATTCTAGTTGNGNTTG TCCAAACTCATCAATGN ATNTNTCATGTCTGGNTC GCACCNTGGNNTGAAAN NACCTNNTGAANNNGNN | | | | |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | CNNCCCCANCNANAAAANCNTNNNNNNAGCNNANNNGNNNNNCCCNNAN (SEQ ID NO: 3402) | | | CTNNGN (SEQ ID NO: 3404) | | |
| | V-C003 | NNNNNNNNNNNNTGNNTCNTACACATACGATTTAGGTGACACTATAGAATAACATCCACTTTGCCTTTCTCTCCACAGGTGTCCACTCCCAGGTCCAACTGCACCTCGGTTCTATCGATTGAATTCCACCATGGGATGGTCATGTATCATCCTTTTTCTAGTAGCAACTGCAACCGGTGTACATTCCCAGGTGCAGCTACAGCAGTGGGGCGCAGGACTGTTGAAGCCTTCGGAGACCCTGTCCCTCACCTGCGCTGTCTCTGGTGGGTCACTCAGTGGTTTCTACTGGACCTGGATCCGCCAGCCCCCAGGAAAGGGGCTGGAGTGGATTGGGGAAACCAATCATTTTGGAAGCACCGGCTACAAGCCGTCCCTCAAGAGTCGAGTCACCATATCAGTAGACATGTCCAGGAACCAGTTCTCCCTGAAGGTGACCTCTGTGACCGCCGCGGACACGGCTGTGTATTACTGTGCGAGAAAGCCCCTCCTCTACAGTGACTTCTCTCCTGGTGCTTTTGATATCTGGGGCCAAGGGACAATGGTCACCGTCTCTTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCTGTGACGGTCTCGTGGAACTCAGGCGCCCTGACCAGCGGCGTGCACACCTTCCCGGCTGTCCTACAGTCCTCAGGACTCTACTCCCTCAGCAGCGTGGTGACCGTGCC | CAGGTGCAGCTACAGCAGTGGGGCGCAGGACTGTTGAAGCCTTCGGAGACCCTGTCCCTCACCTGCGCTGTCTCTGGTGGGTCACTCAGTGGTTTCTACTGGACCTGGATCCGCCAGCCCCCAGGAAAGGGGCTGGAGTGGATTGGGGAAACCAATCATTTTGGAAGCACCGGCTACAAGCCGTCCCTCAAGAGTCGAGTCACCATATCAGTAGACATGTCCAGGAACCAGTTCTCCCTGAAGGTGACCTCTGTGACCGCCGCGGACACGGCTGTGTATTACTGTGCGAGAAAGCCCCTCCTCTACAGTGACTTCTCTCCTGGTGCTTTTGATATCTGGGGCCAAGGGACAATGGTCACCGTCTCTTCAG (SEQ ID NO: 3407) | COV107_P2_E5 | NNNNNNNNNNNNATGTATCNTACACATACGATTTAGGTGACACTATAGAATAACATCCACTTTGCCTTTCTCTCCACAGGTGTCCACTCCCAGGTCCAACTGCACCTCGGTTCTATCGATTGAATTCCACCATGGGATGGTCATGTATCATCCTTTTTCTAGTAGCAACTGCAACCGGTGTACATTCAGAAATTGTGTTGACGCAGTCTCCAGGCACCCTGTCTTTGTCTCCAGGGGAAAGAGCCACCCTCTCCTGCAGGGCCAGTCAGACTGTTACCGCCAACTACTTAGCCTGGTACCAGCAGAAACCTGGCCAGGCTCCCAGACTCCTCATCTATGGTGCATCCAAGAGGGCCACTGGCATCCCAGACAGGTTCAGTGGCAGTGGGTCTGGGACAGACTTCACTCTCAGCATCAGCAGACTGGAGCCTGAAGATTTTGCAGTGTATTACTGTCAGCAGTATACTACACCTCGGACTTTCGGCGGAGGGACCAAGGTGGAGATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCA | GAAATTGTGTTGACGCAGTCTCCAGGCACCCTGTCTTTGTCTCCAGGGGAAAGAGCCACCCTCTCCTGCAGGGCCAGTCAGACTGTTACCGCCAACTACTTAGCCTGGTACCAGCAGAAACCTGGCCAGGCTCCCAGACTCCTCATCTATGGTGCATCCAAGAGGGCCACTGGCATCCCAGACAGGTTCAGTGGCAGTGGGTCTGGGACAGACTTCACTCTCAGCATCAGCAGACTGGAGCCTGAAGATTTTGCAGTGTATTACTGTCAGCAGTATACTACACCTCGGACTTTCGGCGGAGGGACCAAGGTGGAGATCAA (SEQ ID NO: 3409) | COV107_P2_E5 |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| | CTCCAGCAGCTTGGGCACC CAGACCTACATCTGCAACG TGAATACAAGCCCCAGCAA CACCAAGGTGACAAGAGA GTTGAGCCCAAATCTTGTG ACAAAACTCACATGCCC ACCGTGCCAGCACCTGAA CTCCTGGGGGACCCGTCAG TCTTCCTCTTCCCCCCAAAA CCCAAGGACACCCTCATGA TCTCCCGGACCCCTGAGGT CACATGCGTGGNGGTGGNC GTGAGCCACGAANACCCTG ANNCAAGTTCAACTGGNAC NTGNNGGCNNNNNNGCATA NGCCANGAANAAGCCNCGG NAGNANCANTANANNGCNC GTACNNNNNNAGCNTCNN NCNNNCNGCNCANNACTNN NNANNNNNNGNNNNNNNN NNNAGNNNCANNANNCNN NCCNNNNCNTCNANNANN NTNNNNAANNNNAAGGGN NN (SEQ ID NO: 3406) | | | | |
| V-C004 | NNNNNCNNATGTATCNTA CACNTACGATTTAGGTGAC ACTATAGAATAACATCCAC TTTGCCTTTCTCTCCACAGG TGTCCACTCCCAGGTCCAA CTGCACCTCGGTTCATCGA TTGAATTCCACCATGGGAT GGTCATGTATCATCCTTTTT CTAGTAGCAACTGCAACCG GTGTACATTCCAGGTGCA GCTACAGCAGTGGGCGCA GGACTGTTGAAGCTTTCGG AGACCCTGTCCCTCTCCTGC GCTGTGTATGTGGGTCCCT CAGTGGTTACTACTGTGCG | CAGGTGCAGCTACAGCAGT GGGGCGCAGGACTGTTGAA GCCTTTCGGAGACCCTGTCC CTCTCCTGCGCTGTCTATGG TGGTTCCCTCAGTGGTTACT ACTGAGCTGGATCGCCA GCCCCCAGGGAAGGGGCTG GAGTGGATTGGGAGATCA ATCATTTTGGAAGCACCGG CTACAACCCGTCCCTCAAG AGTCAGTCACCATCTCCG TGGACACGTCCAAGAGCCA GTTCTCCGTGAAGCTGAGC TCTGTGACCGCCGGGACA CGGCTGTCTATTACTGTGCG | COV107_P1_D6 | NNNNNNNNNNNTATGNA TCNTACACATACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTGTACATTCCAGAA TTGTGTTGACGCAGTCTC CAGGCACCGTCTCTTTGT CTCCAGGGAAAGAGCC ACCCTCTCCTGCTGGGCC | GAAATTGTGTTGACGCAGTC TCCAGGCACCGTCTCTTTGT CTCCAGGGAAAGAGCCAC CCTCTCCTGCTGGGCCAGTC AGAGTGTTAGCGCCAGCTAC TTAGCCTGGTACCAGCAGAA ACCTGGCCAGGCTCCCAGGC TCCTCATCTATGGTGCATCC AGCAGGGCCACTGGCATCC CAGACAGGTTCAGTGGCAG TGGGTCTGGGACAGACTTCA CTCTCACCATCAGTAGACTG GAGCCTGAAGATTTTGCAGT ATATTACTGTCAGCAGTACG GTACACACCTCGGACTTTC | COV107_P1_D6 |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| | TGGATCCGCCAGCCCCC TABLE 15-continued Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C005 | NNNNNNNNNNATGTATCA TACACATACGATTTAGGTG ACACTATAGAATAACATCC ACTTTGCCTTTCTCTCCACA GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCTCAGGTG CAGCTGGTGGAGTCTGGAG GAGGCTTGATCCAGCCTGG GGGGTCCCTGAGACTCTCC TGTGCAGCCTCTGGGTTCAC CGTCAGTAGCAACTACATG AGCTGGGTCCGCCAGGCTC CAGGGAAGGGGCTGGAGTG GGTCTCAGTTATTTATAGCG GTGGTAGTACATACTACGC AGACTCCGTGAAGGGCCGA TTCACCATCTCCAGAGACA ATTCCAAGAACACGCTGTA TCTTCAAATGAACAGCCTG AGAGCCGAGGACACGGCCG TGTATTACTGTGCGAGAGG CGAGGGGTGGGAGCTACCA TACGACTACTGGGGCCAGG GAACCCTGGTCACCGTCTC CTCAGCGTCGACCAAGGGC CCATCGGTCTTCCCCCTGGC ACCCTCCTCCAAGAGCACC TCTGGGGCACAGCGGCCC CTACTTCCCCGAACCTGTGA CGGTCTCGTGAACTTCAGG CGCCCTGACCAGCGGCGTG CACACCTTCCCGGCTGTCCT ACAGTCCTCANGACTCTAC TCCCTCAGCAGCGTGGTGA | GAGGTGCAGCTGGTGGAGT CTGGAGGAGGCTTGATCCA GCCTGGGGGGTCCCTGAGA CTCTCCTGTGCAGCCTCTGG GTTCACCGTCAGTAGCAAC TACATGAGCTGGGTCCGCC AGGCTCCAGGGAAGGGGCT GGAGTGGGTCTCAGTTATTT ATAGCGGTGGTAGTACATA CTACGCAGACTCCGTGAAG GGCCGATTCACCATCTCCA GAGACAATTCCAAGAACAC GCTGTATCTTCAAATGAAC AGCCTGAGAGCCGAGGACA CGGCCGTGTATTACTGTGC GGTCTCAGTTATTTATAGCG GTGGTAGTACATACTACGC | | | | | |
| | | CCGTCTTCCTCCAG (SEQ ID NO: 3415) | | COV107_P2_A4 | | | |
| | | | | | NNNNNNNNTATGTATCN TACACATACGATTTAGGT GACACTATAGAATAACA TCCACTTTGCCTTTCTCT CCACAGGTCCACTGCACC AGTCCAACTGCACCTC GGTTCTATCGATTGAATT CCACCATGGATGGTCA TGTATCATCCTTTTTCTA GTAGCAACTGCAACCGG GTACAACTGCAACCGG TTCCTGGGCCCAGTCGC CCTGACTCAGCCTCCCTC CGCTCCGGGTCTCCTGG ACAGTCAGTCACCATCTC CTGCACTGGAACCAGCA GTGACGTTGGTGGTTATA AGTATGTCTCCTGGTACC AACAGCACCCAGGCCAA GCCCCCAAACTCATGATT TATGAGGTCAGTAAGCG GCCCTCAGGGGTCCCTG ATCGCTTCTCTGGCTCCA AGTCTGGCAACACGCCC TCCCTGACCGTTTCTGGG CTCCAGGCTGAGGATGA GGCTGATTATTACTGCAG CTCATATGAAGGCAGCA ACAATTTGTGGTATTCG GCGGAGGGACCAAGCTG ACCGTCCTAGGTCAGCC CAAGGCTGCCCCCTCGG TCACTCTGTTCCCACCCT CGAGTGAGGAGCTTCAA GCCAACAAGGCCACACT GGTGTGTCTCATAAGTG ACTTCTACCCGGGAGCC GTGACAGTGGCCTGAA GGCAGATAGCAGCCCCG TCAAGGCGGGAGTGGAG | CAGTCTGTGCTGACTCAGCC TCCCTCCGCGTCCGGGTCTC CTGGACAGTCAGTCACCATC TCCTGCACTGGAACCAGCAG TGACGTTGGTGGTTATAAGT ATGTCTCCTGGTACCAACAG CACCCAGGCCAAAGCCCCCA AACTCATGATTTATGAGGTC AGTAAGCGGCCCTCAGGGG TCCCTGATCGCTTCTCTGGC TCCCTGACCGTTTCTGGGC TCCAGGCTGAGGATGAGGC TGATTATTACTGCAGCTCAT ATGAAGGCAGCAACAATTT GGGTATTCGGCGGAGGGA CCAAGCTGACCGTCCTAG (SEQ ID NO: 3417) | COV107_P2_A4 |
| | | | | | GGAATTAANTTCGNCGC AGCACNTGGCNTGAAAT NACCTCTGAAAGANGAA CTTG (SEQ ID NO: 3412) | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCGTGCCCTTCAGCAGCTT GGGCACCCAGACCTTACATC TGCAACGTGAATCACAAGC CCAGCAACACCAANNGTGAA CAAGANAGTTGAGCCCAAA TCTTGTGACAAAACTCACA CATGCCACCGTGCCCAGC ACCTGAACTCCTGGGGGA CCGTCAGTCTTCCTCNTCCC CCCAAAACCCNNNCACCNG CATGATCTNCCNNACCCNG AGTCNNNNTGNNNNNGGNGG NNGNNGTGANCNNNNNANA CCCTGNNNGTCAAGTTCAA NTGGNACNN (SEQ ID NO: 3414) | | | ACCACCACACCCTCCAA ACAAAGCAACCAACAAGT ACGCGCCAGCAGCTAC CTGAGCCTGACGCCTGA GCAGTGGAAGTCCCACA GAAGCTACAGCTGCCAG GTCACGCATGNAAGGGA GCACCGTGGNNAAGACA GTGGCCCTACAGAATG TTCATAGAAGCTTGCC GCCATGGCCCAACTGTT TATTGCAGCTTATAATGG NTACNAATAAAGCATAG CATACAAATTTCACAA ATAAAGCATTTTTTCAC TGCATTCTANTTGTNGNT NGTCCAAACTCATCNAT GNNNCTTATCATGTCTGG NTCGGGAATTAANTNNG NNGACAGNCNCNNGN (SEQ ID NO: 3416) | | |
| V-C006 | NNNNNNNNTATGNATCNT ACACATACGATTTAGTGA CACTATAGAATAACATCCA CTTTGCCTTTCTCTCCACAG GTGTCCACTCCCAGGTCCA ACTGCACCTCGGTTCTATCG AGTTACTACGGCCCCCAGGGAA TGGTCATGTATCATCCTTTT TCTAGTAGCAACTGCAACC GGTGTACATTCCCAGCTGC AGCTGCAGGAGTCGGGCCC AGGACTGGTGAAGCCTTCG GCACTGTCTCTGGTCCCTCC GTCAGCAGTGGTAGTTACT ACTGAGCTGGATCCGGCA GCCCCAGGAAGGGACTG GAATGGATTGGTATATCT ATTACAGTGGGTATATCT CTACAACCCCCTCCTCAAG AGTCGAGCGTCCAAGAACCA TGGACAGTTCCAAGAACCA GTTCTCCCTGAAGCTGAGCT | CAGGTGCAGCTGCAGGAGT CGGGCCCAGGACTGGTGAA GCCTTCGGAGACCCTGTCC CTCACCTGCACTGTCTCTGG TGTCCCACTCCCAGGTCCA AGTTACTACGGCCCCCAGTGGT TCCGGCAGCCCCCAGGGAA GGGACTGGAATGGATTGGG TATATCTATTACAGTGGGA GCACAACTACAACCCCTC CCTCAAGAGTCGAGTCACC ATATCAGTGGACACGTCCA AGAACCAGTTCTCCCTGAA GCTGTCTCTGGTGACCGCT GCGGACACCGCCGTGTATT ACTGTGCGAGAGAGGCGGCCC CGGTGGAACGTATAGCAAC ACCTGGTACCCCCAACCG ATACCAACTGGTTCGACAC CTGGGGCCAGGGAACCCTG GTCACCGTCTCCTCAG (SEQ ID NO: 3419) | COV107_P2_F12 | NNNNNNNNATGTATC NTACACATACGATTTAG GTGACACTATAGAATAA CATCCACTTTGCCTTTCT CTCCACAGTGTCCACTC CCAGTCCAACTGCACC TCGGTTCTATCGATTGAA TTCCACCATGGGATGGTC ATGTATCATCCTTTTTCT AGTAGTAACTGCAACCG GTTCTGTGACCTCCTATG AGTCAGTGCAGGCCACCC TCAGTCAGTGGCCCC AGGAAAGACGCCCAGGA TTACCTGTGGGGAAAC AACATTGAAGTAAAAG TGGCACTGGTACCAGC AGAAGCCAGGCCAGCC CCTGTGCTGGTCATCTAT TTTGATAGCCAGCC GTCCAGGGATCCCTGAGC GATTCTCTGGCTCCAACT CTGGGAACACGGCCACC | TCCTATGCTGACTCAGCC ACCCTCAGTGTCAGTGGCC CAGGAAAGACGGCCAGGAT TACCTGTGGGGAAACAAC ATTGAAGTAAAAGTGTC ACTGGTACCAGCAGAAGCC AGGCCAGGCCCCTGTGCTGG TCATCTATTTTGATAGCGAC CGGCCCTCAGGGATCCTGA GCGATTCTCTGGCTCCAACT CTGGGAACACGGCCACCCT GACCATCAGCAGGGTCGAA GCCGGGGATGAGGCCGACT ATTACTGTCAGTGTGGGAT AGTAGTCGTGATCATGTGT ATTCGGCGGAGGGACCAAG CTGACCGTCCTAG (SEQ ID NO: 3421) | COV107_P2_F12 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | CTGTGACCCGCTGCGACAC<br>GGCCGTGTATTACTGTGCG<br>AGAGAGCGGCCCGGTGGAA<br>CGTATAGCAACACCTGGTA<br>CACCCCAACCGATACCAAC<br>TGGTTCGACACCTGGGGCC<br>AGGGAACCCTGGTCACCGT<br>CTCCTCAGCGTCGACCAAG<br>GGCCCATCGGTCTTCCCCCT<br>GGCACCCTCCTCCAAGAGC<br>ACCTCTGGGGCACAGCGG<br>CCCTGGGCTGCCTGGTCAA<br>GGACTACTTCCCCGAACCT<br>GTGACGGTCTCGTGGAACT<br>CAGGCGCCTGACCAGCGG<br>CGTGCACACCTTCCCGGCT<br>GTCCTACAGTCCTCANGAC<br>TCTACTCCCTCAGCAGCGTG<br>GTGACCGTGCCCTCCAGCA<br>GCTTGGGCACCCAGACCTA<br>CATCTGCAACGTGAATCAC<br>AAGCCCAGCAACACCAAGG<br>TGGACAAGAGAGTTGAGCC<br>CAAATCTTGTGACAAAACT<br>CACACATGCCACCGTGCC<br>CAGCACCTGAACTCCTGGG<br>GGGANCGTCAGTCTTCCTCT<br>TCCCCCCAAAACCCAAGGA<br>CACCCTCATGATCTCCCGG<br>ACCCCTGAGTCACATGCGT<br>NNNNNGANGTGANCCACGA<br>ANACCCTGAGNCAAGTTCA<br>CTGGNACGTNNNNNNTNNNN<br>NNCATNANNCANNAANAA<br>GCNNNNGGANGANCANTN<br>NANNNNACNNNCNNNNNN<br>NGNNAGCNTCNTNNCGNNC<br>NNNNNCNNNNTNNNTNAANN<br>NNNGNNNNNANNNNNNNN<br>NCNNNNNNCCNNNCNNNNNCC<br>ATCNNNANCNTNNNNNNA<br>NNNNNN (SEQ ID<br>NO: 3418 | | | CTGACCATCAGCAGGGT<br>CGAAGCCGGGGATGAGG<br>CCGACTATTACTGTGTCAGG<br>TGTGGGATAGTAGTCGT<br>GATCATGTGGTATTCGGC<br>GGAGGGACCAAGCTGAC<br>CGTCCTAGGTCAGCCCA<br>AGGCTGCCCCCTCCGTC<br>ACTCTGTTCCCGCCCCTG<br>AGTGAGGAGCTTCAAGC<br>CAACAAGGCCACACTGG<br>TGTGTCTCATAAGTGACT<br>TCTACCCGGGAGCCGTG<br>ACAGTGGCCTGGAAGGC<br>AGATAGCAGCCCCGTCA<br>AGGCGGGAGTGGAGACC<br>ACCACACCCTCCAAACA<br>AAGCAACAACAAGTACG<br>CGGCCAGCAGCTACCTG<br>AGCCTGACGCCTGAGCA<br>GTGGAAGTCCCACAGAA<br>GCTACAGCTGCCAGTC<br>ACGCATGAAGGGAGCAC<br>CGTGGAGAAGACAGTGG<br>CCCCTACAGAATGTTCAT<br>AGAAGCTTGGCCGCCAT<br>GGCCCAACTTGTTTATTG<br>CAGCTTATAATGGTTACA<br>AATAAAGCAATAGCATC<br>ACAAATTCACAAATAA<br>AGCATTTTTTTCACTGCA<br>TTCTANTTGTGGTTTGTC<br>CAAACTCATCAATGTATC<br>TTATCATGTCTGGATCGG<br>GAATTAATTCGNCGCAG<br>CACCATGNNNTGAAATA<br>ACCTCTGAAAGAGNAAC<br>NN (SEQ ID NO:<br>3420) | |

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | miniprep sequence | original nt sequence | sequence ID (plate/well) |
| | V-C007 | NNNNNNNNATGTATCNTA CACATACGATTAGGTGAC ACTATAGAATAACATCCAC TTTGCCTTTCTCTCCACAGG TGTCCACTCCCAGGTCCAA CTGACACCTCGGTTCTATCGA TTGAATTCCACCATGGGAT GGTCATGTATCATCCTTTTT CTAGTAGCAACTGCAACCG GTGTACATTCCCAGGTTCA GCTGTGCAGTCTGGAGCT GAGGTGAAGAAGCCTGGGG CCTCAGTGAGGGTCTCCTG CAAGGCTTCTGGTTACACCT TTACCAGCTATGGTTTCAGC TGGGTGCGACAGGCCCCTG GACAAGGGCTTGAGTGGAT GGGATGGATCAGCGCTTAC AACCGGTTTTTTTGACTACT AATGTAAACACAAACTTTG CACAGAAGCTCCAGGGCAG AGTCACCATGACCACAGAC ACATCCACGAGCACAGCCT ACATGGAGCTGAGGAGCCT GAGATCTGACGACACGGCC GTGTATTACTGTGCGAGAG GGGAAGCAGTGGCTGGTAC AACCGGTTTTTTTGACTACT GGGGCCAGGGAACCCTGGT CACCGTCTCCTCAGCGTCG ACCAAGGGCCCATCCGTCT TCCCCCTGGCACCCTCCTCC AAGAGCACCTCTGGGGGCA CAGCGGCCCTGGGCTGCCT GGTCAAGGACTACTTCCCC GAACCTGGAGCGTCTGT GGAACTCAGGCGCCCTGAC CAGCGGCGTGCACACCTTC CCGGCTGTCCTACAGTCCTC AGGACTCTACTCCCTCAGC AGCGTGGTGACCGTGCCCT CCAGCAGCTTGGGCACCCA GACCTACATCTGCAACGTG AATCACAAGCCCAGCAACA CCNAAGGTGGACAAGANAG | CAGGTTCAGCTGGTGCAGT CTGGAGCTGAGGTGAAGAA GCCTGGGGCCTCAGTGAGG GTCTCCTGCAAGGCTTCTGG TTACACCTTTACCAGCTATG GTTTCAGCTGGGTGCGACA GGCCCCTGGACAAGGGCTT GAGTGGATGGGATGGATCA GCGCTTACAATGGTAACAC AAACTTTGCAGAGAAGTTCA CAGGGCAGAGTCACCATGA CCACAGACACATCCATGAG CTACAGCCTCTG AGGAGCCTGAGATCTGACG ACACGCCGTGTATTACTG TGCGAGAGGGGAAGCAGTG GCTGGTACAACCGGTTTTT TGACTACTGGGGCCAGGGA ACCCTGGTCACCGTCTCCTC AG (SEQ ID NO: 3423) | COV107_ P1_F3 | NNNNNNNNNNNNNG NATTCACACNTACGATTT AGTGACACTATAGAAT AACATCCACTTTGCCTTT CTCTCCACAGGTGTCCAC TCCAGGTCCAACTGCA CCTCCGGTTCTATCGATTG AATTCCACCATGGGATG GTCATGTATCATCCTTTT TCTAGTAGCAACTGCAA CCGGTTCCTGGGCCCAGT CTGTGCTGACTCAGCCAC CCCGGCAGGAGGGTCAC CATCTCTTGTTCTGGAAGC CATCCTCTGTTCTCTGGAAG CAGTCCAACATCGGAA GTAATTATGTATACTGGT ACCAGCAGCTCCCAGGA ACGGCCCCAAACTCCT CATCTATAGGAATAATC AGCGGCCCTCAGGGGTC CCTGACCGATTCTCTGGC TCCAAGTCTGGCACCTCA GCCTCCCTGGCCATCAGT GGGCTCCGGTCCGAGGA TGAGGCTGATTATTACTG TGCAGCATGGGATGACA GCCTGAGTGGTGTTTGTGG TATTCGGCGGAGGGACC AAGCTGACCGTCCTAGG TCAGCCCAAGGCTGCCC CCTCCGTCACTCTGTTCC CGCCCTCGAGTGAGGAG CTTCAAGCCAACAAGGC CACACTGGTGTGTCTCAT AAGTGACTTCTACCCGG GAGCCGTGACAGTGGCC TGGAAGGCAGATAGCAG CCCCGTCAAGGCGGGA TGGAGACCACCACACC TCCAAACAAAGCAACAA CAAGTACGGCCCAGCA GCTACCTGAGCCTGACG CCTGAGCAGTGGAAGTC | COV107_ P1_F3 |
| | | CCNAAGGTGGACAAGANAG | | | CCTGAGCAGTGGAAGTC (SEQ ID NO: 3425) | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TTGAGCCCAAATCTTGTGA CAAAACTCACACATGCCCA CCGTCCCAGCACCTGAAC TNCTGGGGGACCGTCAGT CTTCCTCTCTCCCCNAAAC CCAAGGACANCCTCATGAT NTNCCNGACCCNTGAGTCA CATGNNGTNGTGNNGGNCG TGNNCCACNAANNACCNNG NAGGTCAAGTTCAACNGGN ACNNNGNNN (SEQ ID NO: 3422) | | | CCACAGAAGCTACAGCT GCCAGGTCACGCATGAA GGGAGCACCGTGGAGAA GACAGTGGCCCCTACAG AATGTTCATAGAAGCTT GGCCGCCATGGCCCAAC TTGTTTATTGCAGCTTAT AATGGTTACAAATAAAG CAATAGCATCACAAATT TCACAAATAAAGCATTTT TTTCACTGCATTCTAGTT GNGGNTTGTCCAAACTC ATCAATGTATCTNATCAT GTCTGGNTCNGGGANTA ATTCNGCCAGCACCAT GGCNTGAAANNACCTCT GAAAGAGNNTNNNGNNT CNNCTNNGNNNNNNNNT CNGNGANNGNGNTCAN TNNNNNGAAAGNCCCC NGNNNCCNNCAGNNNA NNNTGN (SEQ ID NO: 3424) | | |
| V-C008 | NNNNNNCNTATGNATCNT ACATATAGATTTAGGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACATTCCCAGGTGC AGCTCCAGGAGTCGGGCCC AGGACTGGTGAAGCCTTCG GGGACCCTGTCCCTCACCT GCGCTGTCTCTGGTGGCTCC ATCAGCAGTACTAACTGGT GGAGTTGGGTCCGCAGCC CCCAGGGAAGGGCTGGAG TGGATTGGGAAAATCTATC ATACTGGGAGCACCAACTA CAACCCGTCCCTCAAGAGT CGAGTCACCATATCAGTAG | CAGGTGCAGCTGCAGGAGT CGGGCCCAGGACTGGTGAA GCCTTCGGGGACCCTGTCC CTCACCTGCGCTGTCTCTGG TGGCTCCATCAGCAGTACT AACTGGTGGAGTTGGGTCC GCCAGCCCCAGGGAAGGG GCTGGAGTGGATTGGGGAA ATCTATCATACTGGGAGCA CCAACTACAACCCGTCCCT CAAGAGTCGAGTCACCATA TCAGTAGACAAGTCCAAGA ACCAGTTCTCCCTGAAGCT GAGCTCTGTGACCGCCGCG GTGTGAGAGATGAGGACG ACCCGGGGATGCTTTTGAT ATCTGGGGCCAAGGGACAA TGGTCACCGTCTCTTCAG (SEQ ID NO: 3427) | COV107_P2_E9 | NNNNNNNNTTATGTAT CNTACNCATACGATTTA GGTACACTATAGAATA ACATCACCTTTGCCTTTC TCTCCACAGGTGTCCACT CCCAGGTCCAACTGCAC CTCGGTTCTATCGATTGA ATTCCACCATGGATGA TCATGTATCATCCTTTTT CTAGTAGCAACTGCAAC CGGTTCCTGGGCCCAGTC TGCCTGACCATCTCTGGC CTCCCGTCTCGGGTCCC TGGACAGTCGATCACCA TCTCCTGCACTGGAACCA GCAGTGGTTGGTGGT TATAACTATGTCTCCTGG TACCAACAACACCCCAGG CAAAGCCCCAAACTCA TGATTTATGATGTCAGTA ATCGGCCCTCAGGGGTTT | CAGTCTGTGCTGACTCAGCC TGCCTCCGTGTCTGGGTCTC CTGGACAGTCGATCACCATC TCCTGCACTGGAACCAGCAG TGACGTTGGTGGTTATAACT ATGTCTCCTGGTACCAACAA CACCCAGGCAAAGCCCCA AACTCATGATTTATGATGTC AGTAATCGGCCCTCAGGGGT TTCTAATCGCTTCTCTGGCT CCAAGTCTGGCAACACGGC CTCCCTGACCATCTCTGGGC TCCAGGCTGAGGACGAGGC TGATTATTACTGCAACTCAT ATACAAGCAGCAGCACTCG AGTCTTCGGAACTGGGACCA AGTCACCGTCCTAG (SEQ ID NO: 3429) | COV107_P2_E9 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | ACAAGTCCAAGAACCAGTT CTCCCTGAAGCTGAGCTCT GTGACCGCCGGGACACGG CCGTGTATTACTGTGTGAG AGATGGAGGACGACCCGGG GATGCTTTTGATATCTGGGG CCAAGGGACAATGGTCACC GTCTCTTCAGCGTCGACCA AGGGCCCATCGGTCTTCCC CCTGGCACCCTCCTCCAAG AGCACCTCTGGGGGCACAG CGGCCCTGGGCTGCCTGGT CAAGGACTACTTCCCCGAA CCTGTGACGGTCTCGTGGA ACTCAGGCGCCCTGACCAG CGGCGTGCACACCTTCCCG GCTGTCCTACAGTCCTCAG GACTCTACTCCCTCAGCAG CGTGTGACCGTGCCCTCC AGCAGCTTGGGCACCCAGA CCTACATCTGCAACGTGAA TCACAAGCCCAGCAACACC AAGGTGGACAAGANAGTTG AGCCCAAATCTTGTGACAA AACTCACACATGCCCACCG TGCCCAGCACCTGAACTNC TGGGGGGACCGTCAGTCTT CCTCTTCCCCCAAANCCNA GGACACCCTCAGTCACATGC CNGACCCTGAGTCACATGC GTGNNNNNNGTGAGCCAC NANANCCTGAGTCAGTTCA ACTGGNACGNNGNGNNGN NNGGNNGNNGCATNATGNN (SEQ ID NO: 3426) | | | | | |
| V-C009 | | NNNNNNNNNTTATGTATCN TACACATACGATTTAGGTG ACACTATAGAATAACATCC | GAGGTGCAGCTGGTGGAGT CTGGGGGAGGCTTGGTCCA GCCTGGGGGGTCCCTGAGA | COV107_P2_D10 | CTAATCGCTTCTCTGGCT CCAAGTCTGCAACACG GCCTCCTGACCATCTCT GGGCTCCAGGCTGAGGA CGAGGCTGATTATTACTG CAACTCATATACAAGCA GCAGCACTCGAGTCTTC GGAACTGGGACCAAGGT CACCGTCTCTAGGTCAGC CCAAGGCCAACCCCACT GTCACTCTGTTCCCACCC TCGAGTGAGAGCTTCA AGCCAACAAGGCCACAC TGGTGTGTCTCATAAGTG ACTTCTACCCGGGAGCC GTGACAGTGGCCTGAA GGCAGATAGCAGCCCCG TCAAGGCGGAGTGGAG ACCACCACACCCTCCAA ACAAAGCAACAACAAGT ACGCGGCCAGCAGCTAC CTGAGCCTGACGCCTGA GCAGTGGAAGTCCACA GAAGCTACAGCTGCCAG GTCACGCATGAANGGGA GCACCGTGGAGAAGACA GTGGCCCCTACAGAATG TTCATAGAAGCTTGGCC GCCATGGNCCAACTTGTT TATTGCAGCTTATAATGG TTACAAATAAAGCAATA GCATACAAATTTCACA AATAAAGCATTTTTTTNA CTGCATTCTANTNGTGGT TNGTCCAANTCATCAAT GTATNNNTCATGTCTGG NTCGGGNATTAATTCGN CGCAGCACCANGGCCTG AANNNACCTCTNNAANN ANN (SEQ ID NO: 3428) | NNNNNNNNNNNNNTAT GTATCNTACACATACGA TTTAGGTGACACTATAG | COV107_P2_D10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | ACTTTGCCTTTCTCTCCACA | CTCTCCTGTGCAGCCTCTGG | | AATAACATCCACTTTGCC | TCCTGCACTGGAACCAGCAG | |
| | | GGTGTCCACTCCCAGGTCC | ATTCACCTTTAGTAGCTATT | | TTTCTCTCCACAGGTGTC | TGACGTTGGTGGTTATAACT | |
| | | AACTGCACCTCGGTTCTATC | GGATGAGCTGGGTCCGCCA | | CACTCCAGGTCCAACT | ATGTCTCCTGGTACCAACAG | |
| | | GATTGAATTCCACCATGGG | GGCTCCAGGGAAGGGGCTG | | GCACCTCGGTTCTATCGA | CACCCAGGCAAAGCCCCA | |
| | | ATGGTCATGTATCATCCTTT | GAGTGGGTGGCCAACATAA | | TTGAATTCCACCATGGG | AACTCATGATTTATGAGGTC | |
| | | TTCTAGTAGCAACTGCAAC | AGCAAGATGAAGTGAGAA | | ATGGTCATGTATCATCCT | ACTAAGCGGCCCTCAGGGG | |
| | | CGGTGTACATTCTGAAGTG | ATACTATGTGGACTCTGTG | | TTTTCTAGTAGCAACTGC | TCCCTGATCGCTTCTCTGGC | |
| | | CAGCTGGTGGAGTCTGGGG | AAGGGCCGATTCACCATCT | | AACCGGTTCCTGGGCC | TCCAAGTCTGGCAACACGGC | |
| | | GAGGCTTGGTCCAGCCTGG | CCGAGACAACGCCAAGAA | | AGTCTGCCCTGACTCAGC | CTCCCTGACCGTCTCTGGGC | |
| | | GGGGTCCCTGAGACTCTCC | CTCACTGTATCTGCACATGA | | CTCCTGCCGTCCGGGT | TCCAGGCTGAGGATGAGGC | |
| | | TGTGCAGCCTCTGGATTCAC | ACAGCCTGAGAGCCGAGGA | | CTCCTGGACCTCAGTC | TGATTATTACTGCAGCTCAT | |
| | | CTTTAGTAGCTATTGGATGA | CACGGCTGTCTATTACTGTG | | ACCATCCTCCACTGGA | ATGCAGGCAGCAACAATTA | |
| | | GCTGGGTCCGCCAGGCTCC | CTATACAGCTATGGTTAAG | | ACCAGCAGTGACGTTGG | TGTGGTATTCGGCGGAGGG | |
| | | AGGGAAGGGGCTGGAGTGG | GGGGGGCTATGACTACTGG | | TGGTTATAACTATGTCTC | ACCAAGCTGACCGTCCTAG | |
| | | GTGGCCAACATAAAGCAAG | GGCCAGGGAACCCTGGTCA | | CTGGTACCAACAGCACC | (SEQ ID NO: 3433) | |
| | | ATGGAAGTGAGAAATACTA | CCGTCTCCTCAG (SEQ | | CAGGCAAAGCCCCCAAA | | |
| | | TGTGACTCTGTGAAGGGC | ID NO: 3431) | | CTCATGATTTATGAGGTC | | |
| | | CGATTCACCATCTCCGGAG | | | ACTAAGCGGCCCTCAGG | | |
| | | ACAACGCCAAGAACTCACT | | | GGTCCCTGATCGCTTCTC | | |
| | | GTATCTGCACATGAACAGC | | | TGGCTCCAAGTCTGGCA | | |
| | | CTGAGAGCCGAGGACACGG | | | ACACGGCCTCCCTGACC | | |
| | | CTGTGTATTACTGTGCTATA | | | GTCTCTGGGCTCCAGGCT | | |
| | | CAGCTATGGTTAAGGGGGG | | | GAGGATGAGGCTGATTA | | |
| | | GCTATGACTACTGGGGCCA | | | TTACTGCAGTCATATGC | | |
| | | GGGAACCCTGGTCACCGTC | | | AGGCAGCAACAATTATG | | |
| | | TCCTCAGCGTCGACCAAGG | | | TGGTATTCGGCGGAGGG | | |
| | | GCCCATCGGTCTTCCCCCTG | | | ACCAAGCTGACCGTCCT | | |
| | | GCACCCTCCTCCAAGAGCA | | | AGGTCAGCCCAAGGCTG | | |
| | | CCTCTGGGGGCACAGCGGC | | | CCCCCTCGGTCACTCTGT | | |
| | | CCTGGCTGCCTGGTCAAG | | | TCCGCCCTCGAGTGAG | | |
| | | GACTACTTCCCCGAACCTGT | | | GAGCTTCAAGCCAACAA | | |
| | | GACGGTGTCGTGGAACTCA | | | GGCCACACTGGTGTGTCT | | |
| | | NGCGCCCTGACCAGCGGCG | | | CATAAGTGACTTCTACCC | | |
| | | TGCACACCTTCCCGGCTGTC | | | GGGAGCCGTGACAGTGG | | |
| | | CTACAGTCCTCANGACTCT | | | CCTGNAAGGCAGATAGC | | |
| | | ACTCCCTCAGCAGCGTGGT | | | AGCCCCTGCAAGGCGGG | | |
| | | GACCGTGCCCTCCAGCAGC | | | AGTGGAGACCACCACAC | | |
| | | TTGGGCACCCAGACCTACA | | | CCTCCAAACAAAGCAAC | | |
| | | TCTGCAACGTGAATCACAA | | | CAGCTACCTGAGCCTGA | | |
| | | GCCCAGCAACCACCNANGTG | | | CGCCTGAGCAGTGGAAG | | |
| | | GACAAGAGAGTTGAGCCCA | | | TCCCACAGAAGCTACAG | | |
| | | AATCTTGTGACAAAACTCA | | | CGCCAGGTCACGCATG | | |
| | | GCACATGCCCACCGTGCCCA | | | ANGGAGCACCGTGGAGA | | |
| | | GCACCTGAACTCCTGGGGG | | | ANACAGTGGCCCCTACA | | |
| | | GACCCTCAGTCTTCCTCTTC | | | | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCCCAAAACCCAAGNANA NCCTTCATGATCTCCNGAC CCCTGAGTCACATGCGTGN NNNGACGTGAGCCACGANA CCCTGAGNCAAGTTCAACT GGNACNNNGNNGNNNNNN GNNNGCATAATGNCANNAA NAAAGCCNN (SEQ ID NO: 3430) | | | GAATGTTCATAGAAGCT TGGCCGCCATGGCCCAA CTTGTTTATTGCAGCTTA TAATGGNTACNAATAAA GCAATAGCATCACAAAT TCNNAAANAAAGCATT ttttcactgcatntan TNGNGGNTTNTCNNAAC TCATCNATGNATCTTATC ATGTCTGGNTNGGAATT NATTCGGNNNNNN (SEQ ID NO: 3432) | | |
| V-C010 | NNNNNNNNNTCNTA CACATACGATTTAGTGAC ACTATAGAATAACATCCAC TTTGCCTTTCTCTCCACAGG TGTCCACTCCCAGGTCCAA CTGCACCCTCGGTTCTATCGA TTGAATTCCACCATGGAT GGTCATGTATCATCCTTTTT CTAGTAGCAACTGCAACCG GTGTACATTCCCAGTACA GCTGCAGCAGTCTGAGGG GAGGTGAAAAGCCCGGGG AGTCTCTGAAGATCTCCTGT AAGGGTTCTGGATACAGCT TTACCAGCTACTACCAGCT CTGGGTGCGCCAGATGCCC GGGAAAGGCTGGAGTGGA TGGGGATCATCTATCCTGGT GACTCTGATACCAGATACA GCCCCGTCCTTCCAAGGCCA GGTCACCATCTCAGCCGAC AAGTCCATCAGCACCGCCT ACATGCAGTGGAGCAGCCT GAAGGCCTCGGACACCGCC ATGTATTACTGTGCGAGAT CGTTCCGGGACGACCCCCG TATAGCAGTGGCTGCCCCG GCTGATGCTTTTGATATCTG GGGCCAAGGGACAATGGTC ACCGTCTCTTCAGCGTCGAC CAAGGGCCCATCCGTCTTC CCCCTGGCACCCTCTCCAA | GAGGTGCAGCTGGTGCAGT CTGGAGCAGAGGTGAAAAA GCCCGGGGAGTCTCTGAAG ATCTCCTGTAAGGGTTCTGG ATACAGCTTTACCAGCTACT GGATCGGCTGGGTGCGCCA GATGCCCGGGAAAGGCTG GAGTGGATGGGGATCATCT ATCCTGGTGACTCTGATACC AGATACAGCCCCGTCCTTCC AAGGCCAGGTCACCATCTC AGCCGACAAGTCCATCAGC ACCGCCTACATGCAGTGGA GCAGCCTGAAGGCCTCGGA CACCGCCATGTATTACTGTG CGAGATCGTTCCGGGACGA CCCCCGTATAGCAGTGGCT GCCCCGGCTGATGCTTTTG ATATCTGGGGCCAAGGGAC AATGGTCACCGTCTCTTCAG (SEQ ID NO: 3435) | COV107_P2_H6 | NNNNNNNNNNATGTAT CNTACACATACGATTTA GGTGACACTATAGAATA ACATCCACTTTGCCTTTC TCTCCACAGTGTCCACT CCCAGGTCCAACTGCAC CTCGTTCTATCGATTGA ATTCCACCATGGGATGG TCATGTATCATCCTTTT CTAGCAACTGCAACC CGGTGTACAATCTGACAT CCAGATGACCCAGTCTC CTTCCACCCTGTCTGCAT CTGTAGGAGACAGAGTC ACCATCCCGTACCTGGGC CAGTCAGAGTATTAGTT ACTGGTTGCCTGGTATC AGCAGAAACCAGGGAAA GCCCCTAAGCTCCTGATC TATCAGGCGTCTAGTTTA GAAAGTGGGGTCCCGTC AAGTTCAGCGGCAGTG AGTCTGGGACAGAATTC ACTCTCACCATCAGCAG CCTGCAGCCTGATGATTT TGCAACTTATTACTGCCA ACAGTATAATAGTTACC CGTACACTTTTGGCCAGG GGACCAAGCTGGAGATC AAACGTACCGTGGCTGC ACCATCTGTCTTCATCTT CCCGCCATCGATGAGC | GACATCCAGATGACCCAGTC TCCTTCCACCCTGTCTGCAT CTGTAGGAGACAGAGTCAC CATCACTTGCCGGGCCAGTC AGAGTATTAGTTACTGGTTG GCCTGGTATCAGCAGAAAC CAGGGAAAGCCCCTAAGCT CCTGATCTATCAGGCGTCTA GTTTAGAAAGTGGGGTCCCG TCAAGGTTCAGCGGCAGTG CTCACCATCAGCAGCCTGCA GCCTGATGATTTTGCAACTT ATTACTGCCAACAGTATAAT AGTTACCCGTACACTTTTGG CCAGGGGACCAAGCTGGAG ATCAAAC (SEQ ID NO: 3437) | COV107_P2_H6 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | GAGCACCTCTGGGGCACA<br>GCGGCCCTGGGCTGCCTGG<br>TCAAGGACTACTTCCCCGA<br>ACCTGTGACCGTCTCGTGG<br>AACTCAGGCGCCCTGACCA<br>GCGGCGTGCACACCTTCCC<br>GGCTGTCCTACAGTCCTCA<br>GGACTCTACTCCCTCAGCA<br>GCGTGGTGACCGTGCCCTC<br>CAGCAGCTTGGGCACCCAG<br>ACCTACATCTGCAACGTGA<br>ATCACAAGCCCAGCAACAC<br>CAAGTGGANANAGAGTTG<br>AGCCCAAATCTTGTGACAA<br>ACTCACACATGCCACCGT<br>GCCCAGCACCTGAACTCCT<br>GGGGGACCGTCAGTCTTC<br>CTCTTCCCCCAAAACCCN<br>NNNCACCCNCATGATCTCC<br>CNNACCCNNGAGTCACATG<br>CNTGGNGNNGGNNGTGNNC<br>CNCNANACCCNGNANGTCA<br>AGTNN (SEQ ID<br>NO: 3434) | | | | | |
| V-011 | | NNNNNNNNNNTAT<br>GTATNNTACACATACGATT<br>TAGGTGACACTATAGAATA<br>ACATCCACTTTGCCTTTCTC<br>TCCACAGGTGTCCACTCCC<br>AGGTCCAACTGGATCCGCA<br>GCCCCCAGGGAAGGGACTG<br>GAGTGGATTGGGTATATCT<br>CATGGGATGGTCATGTATC<br>ATCCTTTTTCTAGTAGCAAC<br>TGCAACCGGTGTACATTCC<br>CAGCTGCAGTGCAGGAGT<br>CGGGCCCAGGACTGGTGAA<br>GCCTTCGGAGACCCTGTCC<br>CTCACCTGCACTGTCTCTGG<br>TGGCTCCATCAGTAGTTACT | CAGGTGCAGCTGCAGGAGT<br>CGGGACCCAGGACTGGTGAA<br>GCCTTCGGAGACCCTGTCC<br>CTCACCTGCACTGTCTCTGG<br>TGGCTCCATCAGTAGTTACT<br>ACTGGAGCTGGATCCGGCA<br>GCCCCCCAGGGAAGGGACTG<br>GAGTGGATTGGGTATATCT<br>ATTACAGTGGGAGCACCAA<br>CTACAACCCCTCCCTCAAG<br>AGTCGAGTCACCATATCAG<br>TAGACACGTCCAAGAACCA<br>GTTCTCCCTGAAGCTGAGCT<br>CTGTGACCGCTGCCGACAC<br>GGCCGTGTATTACTGTGCG | COV107_<br>P2_F11 | NNNNNNNNNNATGNAT<br>CNTACACATACGATTA<br>GGTGACACTATAGAATA<br>ACATCCACTTTGCCTTTC<br>TCTCCACAGGTGTCCACT<br>CCCAGGTCCAACTGCAC<br>CTCGGTTCTATCGATTGA<br>ATTCCACCATGGAGATGG<br>TCATGTATCATCCTTTTT<br>CTAGTAGCAACTGCAAC<br>CGGTTCCTGGCCCAGTC<br>TGTGCTGACGCAGCCAC<br>CCTCGGTGTCTGAAGCCC<br>CCAGGCAGAGGGTCACC<br>ATCTCCTGTTCTGGAAGC | CAGTCTGTGCTGACTCAGCC<br>ACCCTCGGTGTCTGAAGCCC<br>CCAGGCAGAGGGTCACCAT<br>CTCCTGTTCTGGAAGCAGCT<br>CCAACATCGGAAATAATGCT<br>GTAAATTGGTACCAGCAGGT<br>CCCAGGAAAGGCTCCCAAA<br>CTCCTCATCTATTATGATGA<br>TCTGCTCCCTCAGGGGTCT<br>CTGACCGATTCTCTGGCTCC<br>AAGTCTGGCACCTCAGCCTC<br>CCTGGCCATCAGTGGCCTC<br>AGTCTGAGGATGAGGCTGA<br>TTATTACTGTGCAGCATGGG<br>ATGACAGCCTGAATGGCGCT | COV107_<br>P2_F11 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | ACTGGAGCTGGATCCGGCA<br>GCCCCCAGGGAAGGGACTG<br>GAGTGGATTGGGTATATCT<br>ATTACAGTGGGAGACCACCAA<br>CTACAACCCCTCCCTCAAG<br>AGTCGAGTCACCATATCAG<br>TAGACACGTCCAAGAACCA<br>GTTCTCCCCTGAAGCTGAGCT<br>CTGTGACCGCTGCGACAC<br>GGCCGTGTATTACTGTGCG<br>AGAGTAGAAGACTGGGGAT<br>ATTGTAGTAGTACCAACTG<br>CTATTCTGGTGCTTTTGATA<br>TCTGGGGCCAAGGGACAAT<br>GGTCACCGTCTCTTCAGCGT<br>CGACCAAGGGCCCATCGGT<br>CTTCCCCCTGGCACCCTCCT<br>CCAAGAGCACCTCTGGGGG<br>CACAGCGGCCCTGGGCTGC<br>CTGGTCAAGGACTACTTCC<br>CCGAACCTGTGACGGTCTC<br>GTGGAACTCAGGCGCCCTG<br>ACCAGCGGCGTGCACACCT<br>TCCCGGCTGTCCTACAGTCC<br>TCANGACTTCACTCCCTCAG<br>CAGCCTGGTGACCGTGCCC<br>TCCAGCAGTTGGGCACCC<br>AGACCTACATCTGCAACGT<br>GAATCACAAGCCCAGCAAC<br>ACCAAGGTGACAAGAGA<br>GTTGAGCCCAAATCTTGTG<br>ACAAAACTCACACATGCCC<br>ACCGTGCCCAGCACCTGAA<br>CTCCTGGGGGGANCGTCAG<br>TCTTCCTCTTCCCCCCAAAA<br>CCCAAGGACACCCNTCATGA<br>TCTCCCNGNACCCCTGAGG<br>TCNCNTGCGTGGNGNNGN<br>NGTGANCCACGAAGANCCT<br>GANGTCAAGTTNANTCNNN<br>CNNGNNGNCNNNNNGTGC | AGAGTAGAAGACTGGGGAT<br>ATTGTAGTAGTACCAACTG<br>CTATTCTGGTGCTTTTGATA<br>TCTGGGGCCAAGGGACAAT<br>GGTCACCGTCTCTTCAG<br>(SEQ ID NO: 3439) | | AGTCCAACATCGAAA<br>TAATGCTGTAAATTGGTA<br>CCAGCAGGTCCCAGAA<br>AGCCTCCCAAACTCCTC<br>ATCTATTATGATGATCTG<br>CTGCCCCTCAGGGGTCTCT<br>GACCGATTCTCTGGCTCC<br>AAGTCTGGCACCTCAGC<br>CTCCCTGGCCATCAGTGG<br>GCTCCAGTCTGAGGATG<br>AGGCTGATTATTACTGTG<br>CAGCATGGGATGACAGC<br>CTGAATGGCGCTTGGGT<br>GTTCGGCGGAGGGACCA<br>AGCTGACCGTCCTAGGT<br>CAGCCCAAGGCTGCCCC<br>CTCGGTCACTCTGTTCCC<br>ACCCTGAGTGAGGAGC<br>TTCAAGCCAACAAGGCC<br>ACACTGGTGTGTCTCATA<br>AGTGACTTCTACCCGGG<br>AGCCTGACAGTGGCCT<br>GGAAGGCAGATAGCAGC<br>CCCGTCAAGGCGGGAGT<br>GGAGACCACCACACCCT<br>CCAAACAAAGCAACAAC<br>AAGTACGCGGCCAGCAG<br>CTACCTGAGCCTGACGC<br>CTGAGCAGTGGAAGTCC<br>CACAGAAGCTACAGCTG<br>CCAGTTCACCCATGAAG<br>GGAGCACCCGTGGNNAAG<br>ACAGTGGNCCCTACAGA<br>ATGTTCATAGAAGCTTG<br>GCCGCCATGGCCCAACT<br>TGTTTATTGCAGCTTATA<br>ATGGTTACAAATAAAGC<br>AATAGCATCACAAATTT<br>CACAAATAANCATTTTTT<br>CACTGCATCTANTTGNGT<br>TNNTCCAANCTCATCAAT | TGGGTGTTCGGCGGAGGGA<br>CCAAGCTGACCGTCCTAG<br>(SEQ ID NO: 3441) | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | ATANNNANANNAAGCNN<br>NGGANGANNAGTACAACN<br>GCACGTNCNNNNGNNAGC<br>NTCNNCACCNNCCNNNACC<br>NNNNACNNGNNNNANN<br>(SEQ ID NO: 3438) | | | GNATCTNNCATGTCTGG<br>NTCGGGAAN (SEQ<br>ID NO: 3440) | | |
| V-C012 | NNNNNNNNNNTATCGNATC<br>NTACACATACGATTTAGGT<br>GACACTATAGAATAACATC<br>CACTTTGCCTTCTCTCCAC<br>AGGTGTCCACTCCCAGGTC<br>CAACTGCACCTCGGTTCTAT<br>CGATTGAATTCCACCATGG<br>GATGTCATGTATCATCCTT<br>TTTCTAGTAGCAACTGCAA<br>CCGGTGTACATTCTCAGGT<br>GCAGCTGGTGGAGTCTGGG<br>GAGGCGTGGTCCAGCCTG<br>GGAGGTCCCTGAGACTCTC<br>CTGTGCAGCCTCTGGATTCA<br>CCTTCAGTAGCCATGCTATG<br>CACTGGGTCCGCCAGGCTC<br>CAGGCAAGGGGCTGGAGTG<br>GGTGGCAGTTTATATCATAT<br>GATGGAAGCAATAAATACT<br>ACGCAGAGACTCCGTGAAGGG<br>CCGATTCACCATCTCCAGA<br>GACAATTCCAAGAACACGC<br>TGTATCTGCAAATGAACAG<br>CCTGAGAGCTGAGGACACG<br>GCTGTGTATTACTGTGCGA<br>GAGAGGATTACTATGATAG<br>TAGTGGTTCTTTTGACTACT<br>GGGGCCAGGGAACCCTGGT<br>CACCGTCTCCTCAGCGTCG<br>ACCAAGGGCCCATCGGTCT<br>TCCCCCTGGCACCCTCCTCC<br>AAGAGCACCTCTGGGGCA<br>CAGCGGCCCTGGGCTGCCT<br>GGTCAAGGACTACTTCCCC<br>GAACCTGGTGACGGTCTGT<br>GGAACTCAGCGCCCCTGAC<br>CAGCGGCGTGCACACCTTC<br>CCGGCTGTCCTACAGTCCTC | CAGGTGCAGCTGGTGGAGT<br>CTGGGGGAGGCGTGGTCCA<br>GCCTGGGAGGTCCCTGAGA<br>CTCTCCTGTGCAGCCTCTGG<br>ATTCACCTTCAGTAGCCATG<br>CTATGCACTGGGTCCGCCA<br>GGCTCCAGGCAAGGGGCTG<br>GAGTGGGTGGCAGTTTATAT<br>CATATGATGGAAGCAATAA<br>ATACTACGCAGACTCCGTG<br>AAGGGCCGATTCACCATCT<br>CCAGAGACAATTCCAAGAA<br>CACGCTGTATCTGCAAATG<br>AACAGCCTGAGAGCTGAGG<br>ACACGGCTGTGTATTACTGT<br>GCGAGAGAGGATTACTATG<br>ATAGTAGTGGTTCTTTTGAC<br>TACTGGGGCCAGGGAACCC<br>TGGTCACCGTCTCCTCAG<br>(SEQ ID NO: 3443) | COV107_<br>P1_B10 | NNNNNNNNNNNNNNTG<br>NNTCNACACATACGATT<br>TAGGTGACACTATAGAA<br>TAACATCCACTTTGCCTT<br>TCTCTCCACAGGTGTCCA<br>CTCCCAGGTCCAACTGC<br>ACCTCGGTTCTATCGATT<br>GAATTCCACCATGGGAT<br>GGTCATGTATCATCCTTT<br>TTCTAGTAGCAACTGCA<br>ACCGGTTCCTGGCCCAGT<br>CTGCCCTGACTCAGCCTG<br>CCTCCGTGTCTGGGTCTC<br>CTGGACAGTCGATCACC<br>ATCTCCTGCACCGGAAC<br>CAGCAGTGACGTTGGTG<br>GTTATAACTATGTCTCCT<br>GGTACCAACAACCCCAA<br>GCAAAGCCCCAAACT<br>CATGATTTATGATGTCAG<br>TAATCGGCCCTCAGGGG<br>TTTCTAATCGCTTCTCTG<br>GCTCCAAGTCTGGCAAC<br>ACGGCCTCCCTGACCATC<br>TCTGGGCTCCAGGCTGA<br>GGACCAGGCTGATTATT<br>ACTGCAGCTCATATACA<br>AGCAGCAGCACTTGGGT<br>GTTCGGCGGAGGGACCA<br>AGCTGACCGTCCTAGGT<br>CAGCCCAAGGCTGCCCC<br>CTCCGTCACTCTGTTCCC<br>ACCCTCGAGTGAGGAGC<br>TTCAAGCCAACAAGCC<br>ACACTGGTGTGTCTCATA<br>AGTGACTTCTTACCCGGG<br>AGCCGTGACAGTGCCT<br>GGAAGGCAGATAGCAGC | CAGTCTGCCCTGACTCAGCC<br>TGCCTCCGTGTCTGGGTCTC<br>CTGGACAGTCGATCACCATC<br>TCCTGCACCGGAACCAGCA<br>GTGACGTTGGTGGTTATAAC<br>TATGTCTCCTGTACCAACA<br>ACACCAGGCAAAGCCCCC<br>AAACTCATGATTTATGATGT<br>CAGTAATCGGCCCTCAGGG<br>GTTTCTAATCGCTTCTCTGG<br>CTCCAAGTCTGGCAACACG<br>CCTCCCTGACCATCTCTGGG<br>CTCCAGGCTGAGGACGAGG<br>CTGATTATTACTGCAGCTCA<br>TATACAGGCAGCAGCACTTG<br>GGTGTTCGGCGGAGGGACC<br>AAGCTGACCGTCCTAG<br>(SEQ ID NO: 3445) | COV107_<br>P1_B10 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AGGACTCTACTCCCTCAGC AGCTGGTGACCGTGCCCT CCAGCAGCTTGGGCACCCA GACCTACATCTGCAACGTG AATCACAAGCCCAGCAACA CCAAGGTGGACAAGAGAGT TGAGCCCAAATCTTGTGAC AAAACTCACACATGCCCAC CGTGCCCAGCACCTGAACT CCTGGGGGGACCGTCAGTC TTCCTCTTCCCCCCAAAACC CAAGGACACCCTCATGATC TCCCGGACCCCTGAGGTTA CATGCGTGGNGGNGNCGT GAGCCACAGACAAACCCTGAN NCAGTTCANCTGGNACNNG GNNGGCGTNNNNTGCATNA TGNNANAAANAAGCNNNG GGAGGANCAGTANANAGC ACGTACCNNGNNNNNAGCGT CNCNCGTCNGCACANNACT GGNNNANGGNNAGNANTA NNAANNCNNGNNNNNCNN NNANNNNNN (SEQ ID NO: 3442) | | | CCCGTCAAGGCGGGAGT GGAGACCACCACACCCT CCAAACAAAGCAACAAC AAGTACGCGGCCAGCAG CTACCTGAGCCTGACGC CTGAGCAGTGGAAGTCC CACAGAAGCTACAGCTG CCAGGTCACCCATGAAG GGAGCACCGTGGAGAAG ACAGTGGCCCCTACAGA ATGTTCATAGAAGCTTG GCCGCCATGGCCCACT TGTTTATTGCAGCTTATA ATGGNTACAAATAAAGC AATAGCATCACAAATTT CACAAATAAAGCATTTTT TTCACTGCATTCTANTTG TGGTTTGTCCAAACTCAT CAATGTATCTTATCATGT CTGGATCGGGAATTAAN TNNNGCANCACCATGNN NTGAANTAACCTCNGAA GANNACTTNNNNGNACC TTCNGAGNNNANNNNNN CTGNNNNNNNNNGTCANT NGGNNNNNNGNANGTCCC NNGNNCCCNNNAGGCAN ANNNNNCNAAGCATNCA TCTCANNNNNCANCANN ANNNNN (SEQ ID NO: 3444) | | |
| V-C013 | | NNNNNCNNNNTGNATCNT ACACNTACGATTTAGGTGA CACTATAGAATAACATCCA CTTTGCCTTTTCTTCCACAG GTGTCCACTCCCAGGTCCA ACTCACCTCGGTTCTATCG ATTGAATTCCACCATGGGA TGGTCATGTATCATCCTTTT TCTAGTAGCAACTGCAACC GGTGTACATTCTCAGGTGC AGCTGGTGGAGTCTGGGG AGGCTGGTCCAGCCTGGG AGGTCCCTGAGACTCTCCT | CAGGTGCAGCTGGTGGAGT CTGGGGAGGCGTGGTCCA GCCTGGGAGGTCCCTGAGA CTCTCCTGTGCAGCGTCTGG ATTCACCTTCAGTAACTTTG GCATGCACTGGGTCCGCCA GGCTCCAGGCAAGGGGCTG GAGTGGGTGGCAGTTATAT GGTATGATGGAAGTAATAA ATACTATGCAGATTCCGTG AAGGGCCGATTCACCATCT CCAGAGACAATTCCAAGAA CACGCTGTATCTGCAAATG | COV107_P1_D2 | NNNNNNNNNNTATGNAT CNTACACATACGATTTA GGTGACACTATAGAATA ACATCACCTTTGCCTTTC TCTCCACAGGTGTCCACT CCCAGGTCCAACTGCAC CTCGGTTCTTATCGATTGA ATTCCACCATGGATGG TCATGTATCATCCTTTTT CTAGTAGCAACTGCAAC CGGTGTACATTCTGACAT CCAGATGACCCAGTCTC CTTCCACCCCTGTCTGCAT | GACATCCAGATGACCCAGTC TCCTTCCACCCTGTCTGCAT CTGTAGGAGACAGAGTCAC CATCACTTGCCGGGCCAGTC AGAGTATGAGTAGCTGGTTG GCCTGGTATCAGCAGAAAC CAGGGAACGCCCCTAAGCT CCTGATCTATAAGGCGTCTA GTTTAGAAGTGGGGTCCA TCAAGGTTCAGCGGCAGTG GATCTGGGACAGAATTCACT CTCACCATCAGCAGCCTGCA GCCTGATGATTTTGCAACTT | COV107_P1_D2 |

TABLE 15-continued

Additional sequence information for the disclosed anti-SARS-CoV-2 antibodies

| | | HEAVY CHAIN | | LIGHT CHAIN | |
|---|---|---|---|---|---|
| ALICE | AbsID | miniprep sequence | original nt sequence | sequence ID (plate/well) | original nt sequence | miniprep sequence | sequence ID (plate/well) |
| | | GTGCAGCGTCTGGATTCAC CTTCAGTAACTTTGCCATGC ACTGGGTCCGCCAGCCTCC AGGCAAGGGGCTGAGTGG GTGGCAGTTATATGTATG ATGGAAGTAATAAATACTA TGCAGACTCCGTGAAGGGC CGATTCACCATCTCCAGAG ACAATTCCAAGAACACGCT GTATCTGCAAATGAACAGC CTGAGAGCCGAGGACACGG CTGTGTATTACTGTGCGAG AGGAGTAAACCCCGACGAT ATTTTGACTGGCGTAGATG CTTTTGATATCTGGGGCCAA GGGACAATGGTCACCGTCT CTTCAGCGTCGACCAAGGG CCCATCGGTCTTCCCCCTGG CACCCTCCTCCAAGAGCAC CTCTGGGGGCACAGCGGCC CTGGGCTGCCTGGTCAAGG ACTACTTCCCCGAACCTGTG ACGGTCTCGTGGAACTCAG GCGCCCTGACCAGCGGCGT GCACACCTTCCCGGCTGTCC TACAGTCCTCAGGACTCTA CTCCCTCAGCAGCGTGGTG ACCGTGCCCTCCAGCAGCT TGGGCACCCAGACCTACAT CTGCAACGTGAATCACAAG CCCAGCAACACCAAGGTGG ACAAGAGAGTTGAGCCCAA ATCTTGTGACAAACTCAC ACATGCCCACCGTGCCCAG ACCTGAGTTCTCTTCC CCCAAAACCAAGGACAC CCTCATGATCTCCGGACCC CTGAGGTCACATGCCGTGGN GGNNACGTGANCCACGAA GACCCTNAGGTCAAGTTCA ACTGGNACGTNNNGGCNTN NNGTGCATNANGNCCAAGA CNAAGCCGCGGNGANCAGT ACAACANCNNNTACCGTGN | AACAGCCTGAGAGCCGAGG ACACGGCTGTGTATTACTGT ACACGGCTGTAAACCCCG ACGATATTTTGACTGGCGT AGATGCTTTTGATATCTGGG GCCAAGGGACAATGTCAC CGTCTCTTCAG (SEQ ID NO: 3447) | | ATTACTGCCAACAGCATAAT AGTTCCCGCTCACTTTCGG CGAGGGACCAAGGTGGAG ATCAAAC (SEQ ID NO: 3449) | CTGTAGGAGACAGAGTC ACCATCACTTGCCGGGC CAGTGAGAGTGATGAGTA GCTGGTTGCCTGGTATC AGCAGAAACCAGGGAAC GCCCTAAGCTCCTGATC TATAAGGCGTCTAGTTTA GAAAGTGGGGTCCCATC AAGGTTCAGCGGCAGTG GATCTGGGACAGAATTC ACTCTCACCATCAGCAG CCTGCAGCCTGATGATTT TGCAACTTATTACTGCCA ACAGCATAATAGTTCCC CGCTCACTTTCGGCGGA GGGACCAAGGTGGAGAT CAAACGTACGGTGGCTG TCCCGCCATCTGATGAGC AGTTGAAATCTGGAACT GCCTCTGTTGTGTGCCTG TGAATAACTTCTATCCC AGAGAGGCCAAAGTACA GTGGAAGGTGGATAACG CCCTTCCAATCGGGTAACT CCCAGGAGAGTGTCACA GAGCAGGACAGCAAGGA CAGCACCTACAGCCTCA GCAGCACCCTGACGCTG AGCAAAGCAGACTACGA GAAACACAAAGTCTACG CCTGCGAAGTCACCCAT CAGGGCCTGAGCTCCC CGTCACAAAGAGCTTCA ACAGGGGANAGTGTTAG AAGCTTGGCCGCCATGG CCCAACTTGTTATTGCA GCTTATAATGGNTACAA ATAAAGCAATAGCATCA CAAATTTCACNAATAAA GCATTTTTTCACTGCAT TCTANTTGNGGNTNTCC AAACTCATNANNNATNT NNCATGTCTGGNTCGNN NNANTNGNGCAGCNCNT | |

TABLE 15-continued

Additional sequence information for the disclosed anti-SARS-CoV-2 antibodies

| | | HEAVY CHAIN | | | LIGHT CHAIN | | |
|---|---|---|---|---|---|---|---|
| ALICE | AbsID | miniprep sequence | original nt sequence | sequence ID (plate/well) | miniprep sequence | original nt sequence | sequence ID (plate/well) |
| | | NGNNANNNTCNTCACCNNCNNNACCANNANTNNNTNANNNNNGNNTNNNNNNCNNGNNNNNNNAANNNCNTCCNANNNCCATNNNNN (SEQ ID NO: 3446) | | | GNNNGAANNNCNCTGAAGAGANNNNNNNACTNTGAGNGAANANNTNNNNNNNGAATGNNNNNNTCANTNGGGNNNNNNAANTCCCNNGNNNCCCCNNNNNNN (SEQ ID NO: 3448) | | |
| | V-C014 | NNNNNNNNNNNNTGTNTNNACACATACGATTTAGGTGACACTATAGAATAACATCCACTTTGCCTTTCTCTCCACAGGTGTCCACTCCCAGGTCCAACTGCACCTCGGTTCTATCGATTGAATTCCACCATGGGATGGTCATGTATCATCCTTTTTCTAGTAGCAACTGCAACCGGTGTACATTCTCAGGTGCAGCTGGTGGAGTCTGGAGGAGGGTTGATCCAGCCTGGGGGGTCCCTGAAACTCTCCTGTGTAGTCTCTGGGTTCACCGTCAGTAAGAACTACATCAGTTGGGTCCGCCAGGCTCCAGGCAAGGGGCTGGAATGGGTCTCAGTTATTTTTGCCGGTGGTAGTACATTCTACGCAGACTCCGTTAAGGGCCGATTCGCCATCTCCAGAGACAACTCCAACAACACGCTGTTTCTTCAAATGAACAGCCTGAGAGTCGAGGACACGGCCATTTATTACTGTGCGAGAGGGGACGGGGAGTTATTCTTTGACCAATGGGGCCAGGGAACCCTGGTCACCGTCTCCTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCTGTGACGGTCTCGTGGAACTCAGGCGCCCTGACCAGCGGCGTGCACACCTTCCCGGCTGTCCTACAGT | GAGGTGCAGCTGGTGGAGTCTGGAGGAGGGTTGATCCAGCCTGGGGGGTCCCTGAAACTCTCCTGTGTAGTCTCTGGGTTCACCGTCAGTAAGAACTACATCAGTTGGGTCCGCCAGGCTCCAGGCAAGGGGCTGGAATGGGTCTCAGTTATTTTGCCGGTGGTAGTACATTCTACGCAGACTCCGTTAAGGGCCGATTCGCCATCTCCAGAGACAACTCCAACAACACGCTGTTTCTTCAAATGAACAGCCTGAGAGTCGAGGACACGGCCATTTATTACTGTGCGAGAGGGGACGGGGAGTTATTCTTTGACCAATGGGGCCAGGGAACCCTGGTCACCGTCTCCTCAG (SEQ ID NO: 3451) | COV107_P1_G1 | NNNNNNNNNNNNNTATGTATCATACACATACGATTTAGGTGACACTATAGAATAACATCCACTTTGCCTTTCTCTCCACAGGTGTCCACTCCCAGGTCCAACTGCACCTCGGTTCTATCGATTGAATTCCACCATGGGATGGTCATGTATCATCCTTTTTCTAGTAGCAACTGCAACCGGTTCCTGGGCCCAGTCTGTGCTGACTCAGCCGCCCTCAGTGTCTGGGGCCCCAGGGCAGAGGGTCACCATCTCCTGCACTGGGACCAGTTCCAACATCGGGGCAGGTTATGATGTGCACTGGTACCAGCAACTTCCTGGAAGAGCCCCCAAAGTCCTCATCTCTGGAAACAACATTCGGCCCTCAGAGGTCCCTGACCGATTCTCTGGCTCCAGGTCTGGCACCTCAGCCTCCCTGGCCATCACTAGTCTCCAGCCTGAGGATGAGGCTCAATATTACTGTCAGTCTTATGACAGCAGTCTCTATGCGGTGTTCGGCGGAGGGACCAAGCTGACCGTCCTACGTCAGCCCAAGGCTGCCCCCTCGGTCACTCTGTTCCCACCCTCGAGTGAGGAGCTTCAAGCCAACAAGGCCACACTGGTGTGTCTCATAAGTGACTTCTACCCGGGAGCCGTGACAGTGGCCTG | CAGTCTGTGCTGACTCAGCCGCCCTCAGTGTCTGGGGCCCCAGGGCAGAGGGTCACCATCTCCTGCACTGGGACCAGTTCCAACATCGGGGCAGGTTATGATGTGCACTGGTACCAGCAACTTCCTGGAAGAGCCCCCAAAGTCCTCATCTCTGGAAACAACATTCGGCCCTCAGAGGTCCCTGACCGATTCTCTGGCTCCAGGTCTGGCACCTCAGCCTCCCTGGCCATCACTAGTCTCCAGCCTGAGGATGAGGCTCAATATTACTGTCAGTCTTATGACAGCAGTCTCTATGCGGTGTTCGGCGGAGGGACCAAGCTGACCGTCCTA (SEQ ID NO: 3453) | COV107_P1_G1 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCTCAGGACTCTACTCCCTC AGCAGCGTGTGACCGTGC CCTCCAGCAGCTTGGGCAC CCAGACCTACATCTGCAAC GTGAATCACAAGCCCAGCA ACACCAAGGTGGACAAGAG AGTTGAGCCCAAATCTTGT GACAAAACTCACACATGCC CACCGTGCCCAGCACCTGA ACTCCTGGGGGGANCGTCA GTCTTCCTCTTCCCCCCAAA CCCNAGGACACCCCTCATGA TCTCCCGGACCCCTGANTC ACATGCGTGGTGGTGGACG TGAGCCACGAAGACCCTGA GTCAAGTTCANTGGNACNN NGNNGGCNNNGNGTGCAT AATGCCANANNAAGCCNNN GGANGANCANNANANAGC ACNTACCGNGNNNNAGCGT CCTNNNCNNCNNCNNTCNA TGNNNANGNNNCANCNAN NNNCANGGNNNCANCAN CCNTNCCNNCNNCNNTCNA NAAAANNANNNNN (SEQ ID NO: 3450) | | | | | |
| V-C015 | NNNNNNNTATGTATNNTA CACATACGATTTAGGTGAC ACTATAGAATAACATCCAC TTTGCCTTTCTCTCCACAGG TGTCACTTCCCAGGTCCA CTGCACCTCGGTTCTATCGA TTGAATTCCACCATGGGAT GGTCATGTATCATCCTTTTT CTAGTAGCAACTGCAACCG GGTACATTCTCAGGTGCAG CTGGTGGAGTCTGGGGAG GCTTGATAAAGCCAGGGCG GTCCCTGAGACTCTCTTGTA CAGCCTCTGATTCACCTTT GGTGATTATGCTATGACCT | GAGGTGCAGCTGGTGGAGT CTGGGGGAGGCTTGATAAA GCCAGGGCGGTCCCTGAGA CTCTCTTGTACAGCCTCTGG ATTCACCTTTGGTGATTATG CTATGACCTGGTTCCGCCA GGCTCCAGGGAAGGGGCTG GAGTGGGTAGGTTTCATTA GACAACAGGATACGCCGCG TCTGTGAAATACAGATTTA CCATCTCAAGAGATGATTC CAAAGCATCGCCTATCTG CAAATGGACAGCCTGAAAA CCGAGGACACCAGCCGTGTA | COV107_P2_B3 | NNNNNNCNNATGTATCN TACACATACGATTTAGGT GACACTATAGAATAACA TCCACTTTGCCTTTCTCT CCACAGGTGTCCACTCCC AGTTCCAACTGCACCTC GGTTCTATCGATTGAATT CCACCATGGGATGGTCA TGTATCATCCTTTTTCTA GTAGCAACTGCAACCGG GTACATGGGATATTGT GATGACTCAGTCTCCACT CTCCCTGCCCGTCACCCC TGGAGAGCCGGCCTCA TCTCCTGCAGGTCTAGTC (SEQ ID NO: 3452) | GATATTGTGATGACTCAGTC TCCACTCTCCCTGCCCGTCA CCCCTGGAGAGCCGGCCTCC ATCTCCTGCAGGTCTAGTCA GAGCCTCCTGCATAGTAATG GAAACAACTATTTCGATTGG TACCTGCAGAAGCCAGGGC AGTCTCCACAGCTCCTGATC TATTTGGGTTCTAATCGGGC CTCCGGGGTCCCTGACAGGT TCAGTGGCAGTGGATCAGG CACAGATTTACACTGAAGA TCAGCAGAGTGGAGGCTGA GGATGTTGGGGTTTATTACT GCATGCAAGTTCTACAAATT | COV107_P2_B3 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | GGTTCCGCCAGGCTCCAGG<br>GAAGGGGCTGGAGTGGGTA<br>GGTTTCATTAGAAGTAAAG<br>CTTATGGTGGGACAACAGG<br>ATACGCCGCGTCTGTGAAA<br>TACAGATTTACCATCTCAA<br>GAGATGATTCCAAAAGCAT<br>CGCCTATCTGCAAATGGAC<br>AGCCTGAAAACCGAGGACA<br>CAGCCGTGTATTACTGTACT<br>AGGTGGGACGGGTGGAGTC<br>AACATGACTATTGGGGCCA<br>GGGAACCCTGGTCACCGTC<br>TCCTCAGCGTCGACCAAGG<br>GCCCATCGGTCTTCCCCCTG<br>GCACCCTCCTCCAAGAGCA<br>CCTCTGGGGGCACAGCGGC<br>CCTGGGCTGCCTGGTCAAG<br>GACTACTTCCCCGAACCTGT<br>GACGGTCTCGTGGAACTCA<br>NGCGCCCTGACCAGCGGCG<br>TGCACACCTTCCCGGCTGTC<br>CTACAGTCCTCNNNCTCTAC<br>TCCCTCAGCAGCGTGGTGA<br>CCGTGCCCTCCAGCAGCTT<br>GGGCACCCAGACCTACATC<br>TGCAACGTGAATCACAAGC<br>CCAGCANNNCCNNNNNNNN<br>ANANANTTGAGCCCNAATC<br>TNNTGANNAACTCANNCAT<br>GCCCANCGNGCCCAGCACC<br>TGACTNCTGGGGGGANCGT<br>CAGTCTCNNTCCCCNNAAN<br>CNNNNNNNCCNTCATGATN<br>NNCNNACCCTGAGTCACAT<br>GNNNNGGTGGNNGANNTG<br>ANCCNCNANANCCTGAGNC<br>AGTCANTGNANNGNNNGGN<br>NNGNNNNNNCNNNANGCN<br>NANNNANNNNNNGNNNNN<br>NNNNNTNCANNNNGCNNGT<br>NCNNNNGTNNNNNNNNNC<br>NGTNCNNNNNNNNNNTGGN<br>NNANGNNNNNNNNNNANN<br>NNNNNGNNNNNCNNNANN | TTACTGTACTAGGTGGGAC<br>GGGTGGAGTCAACATGACT<br>ATTGGGGCCAGGGAACCCT<br>GGTCACCGTCTCCTCAG<br>(SEQ ID NO: 3455) | | AGAGCCTCCTGCATAGT<br>AATGGAAACAACTATTT<br>CGATTGGTACCTGCAGA<br>AGCCAGGGCAGTCTCCA<br>CAGCTCCTGATCTATTTG<br>GGTTCTAATCGGGCCTCC<br>GGGGTCCCTGACAGGTT<br>CAGTGGCAGTGGATCAG<br>GCACAGATTTTACACTG<br>AAGATCAGCAGAGTGGA<br>GGCTGAGGATGTTGGGG<br>TTTATTACTGCATGCAAG<br>TTCTACAAATTCCGTACA<br>CTTTTGGCCAGGGGACC<br>AAGCTGGAGATCAAACG<br>TACGGTGGCTGCACCAT<br>CTGTCTTCATCTTCCCGC<br>CATCTGATGAGCAGTTG<br>AAATCTGGAACTGCCTCT<br>GTTGTGTGCCTGCTGAAT<br>AACTTCTATCCCAGAGA<br>GGCCAAAGTACAGTGGA<br>AGGTGGATAACGCCCTC<br>CAATCGGGTAACTCCCA<br>GGAGAGTGTCACAGAGC<br>AGGACAGCAAGGACAGC<br>ACCTACAGCCTCAGCAG<br>CACCCTGACGCTGAGCA<br>AAGCAGACTACGAGAAA<br>CACAAAGTCTACGCCTG<br>CGAAGTCACCCATCNGG<br>NCNTGAGCTCGCCCGTC<br>ACAAAGAGCTTCAACNG<br>GGGANANTGTTAGAAGC<br>TTGGNCGCCATGGCCCA<br>ACTTGTTTATTGCAGCTT<br>ATNATGGNTACAAATAA<br>AGCAATAGCATCACAAA<br>TTTCANAATAAAGCATTT<br>TTTTCACTGCATNTANTN<br>NGGNNNTCCAANCTCAT<br>CNATGNATNTATCATGTC<br>TGGNTCNGNATTANTTC<br>GNNNNAGCNNCANN<br>(SEQ ID NO: 3456) | CCGTACACTTTTGGCCAGGG<br>GACCAAGCTGGAGATCAA<br>(SEQ ID NO: 3457) | |

TABLE 15-continued

Additional sequence information for the disclosed anti-SARS-CoV-2 antibodies

| ALICE AbsID | HEAVY CHAIN |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | AACGTGAATCACAAGCCCA GCAACACCAAGGTGACAA GAGAGTTGAGCCCAAATCT TGTGACAAAACTCACACAT GCCCACCGTGCCCAGCACC TGAACTCCTGGGGGACCG TCAGTCTTCCTCTTCCCCCC AAAACCCNNNNNNCCTCA TGATCTCCCGGACCCCTGA GTCACATGCGTGNNNNNNG TGAGCCACGANANCCTGAG NCAGTTCAACTGGNACNNN GNNGGCNNGNNNTGCAN NATGCCNAGACNNAAGCCN N (SEQ ID NO: 3458) | | | CAAGTACGCNGNCNNNC ANN (SEQ ID NO: 3460) | | |
| V-C017 | | NNNNNNNNNATGTATCNTA CACATACGATTAGGTGAC ACTATAGAATAACATCCAC TTTGCCTTTCTCTCCACAGG TGTCCACTCCCAGTCCAA CTGCACCTCGGTTCTATCGA TTGAATTCCACCATGGCAT GGTCATGTATCATCCTTTTT CTAGTAGCAATGCAACCGG TGTACATTCTCAGGTGCAG CTGGTGGAGTCTGGGGAG GCGTGTCCAGCCTGGGAG GTCCCTGAGACTCTCCTGTG CAGCCTCTGATTCACCTTC AGTACCTATGCTATGCACT GGGTCCGCCAGGCTCCAGG CGAGGGGCTGGAGTGGGTG GCAGTTTATTCATATGATGG AAGCAATACATATACGCA GACTCCGTGAAGGGCCGAT TCACCATCTCCAGAGACAA TTCCAAGAACACGCTGTAT CTGCAAATGAACAGCCTGA GAGCTGAAGACACGGCTGT GTATTACTGTGCGAGAGAT CCCATATGGTTCGGGGAGT TATTATCTCCTCCTTTTGTT CACTTTGACTACTGGGGCC AGGGAACCCTGGTCACCGT | CAGGTGCAGCTGGTGGAGT CTGGGGGAGGCGTGTCCAGA GCCTGGGAGGTCCCTGAGA CTCTCCTGTGCAGCCTCTG ATTCACCTTCAGTACCTATG CTATGCACTGGGTCCGCCA GGCTCCAGGCGAGGGGCTG GAGTGGGTGGCAGTTATTT CATATGATGGAAGCAATAC ATATACGCAGACTCCGTG AAGGGCCGATTCACCATCT CCAGAGACAATTCCAAGAA CACGCTGTATCTGCAAATG AACAGCCTGAGAGCTGAAG ACACGGCCATATGGT TCGGGGAGTTATTATCTCCT CCTTTTGTTCACTTTGACTA CTGGGGCCAGGGAACCCTG GTCACCGTCTCCTCAG (SEQ ID NO: 3463) | COV107_P2_H5 | NNNNNNCNNATGTATCN TACACATACGATTAGGT GACACTATAGAATAACA TCCACTTTGCCTTTCTCT CCACAGGTGTCCACTCCC AGTTCCAACTGCACCTC GGTTCTATCGATTCGAATT CCACCATGGGATGGTCA TGTATCATCCTTTTTCTA GTAGCAACTGCAACCGG TTCCTGGGCCCAGTCTGT GCTGACTCAGCCGCCCTC AGTGTCTGCGGCCCCAG GACAGAAGGTCACCATC TCCTGCTCTGGAAGCAG CTCCAACATTGGGAATA ATTTGGTATCCTGGTACC AGCAGCTCCCAAGAACA GCCCCAAACTCCTCATC TATGAAAATAATAAGCG ACCCTCAGGGATTCCTG ACCGATTCTCTGGCTCCA AGTCTGGCACGTCAGCC ACCCTGGGCATCACCGG ACTCAGAGTGGGGACG AGGCCGATTATTACTGC CCTGAGTGCTGGCGGG TTTATGTCTTCGGAACTG | CAGTCTGTGCTGACTCAGCC GCCCTCAGTGTCTGCGGCCC CAGGACAGAAGGTCACCAT CTCCTGCTCTGGAAGCAGCT CCAACATTGGGAATAATTTG GTATCCTGGTACCAGCAGCT CCCAGGAACAGCCCCCAAA CTCCTCATCTATGAAAATAA TAAGCGACCCTCAGGGATTC CTGACCGATTCTCTGGCTCC AAGTCTGGCACGTCAGCCAC CCTGGGCATCACCGGACTCC AGACTGGGGACGAGGCCGA TTATTACTGCGGAGCATGGG ATAGCAGCCTGAGTGCTGGC GGGTTTATGTCTTCGGAACT GGGACCAAGGTCACCGTCC TAG (SEQ ID NO: 3465) | COV107_P2_H5 |

TABLE 15-continued

Additional sequence information for the disclosed anti-SARS-CoV-2 antibodies

| | | HEAVY CHAIN | | | LIGHT CHAIN | |
|---|---|---|---|---|---|---|

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | TGGTCATGTATCATCCTTTT | GAGTGGGTGGCAGTTATAT | | ATTCCACCATGGGATGG | CTTGATGAAGCTTAACACTG | |
| | | TCTAGTAGCAACTGCAACC | CATATGATGGAAGCAATAN | | TCATGTATCATCCTTTTT | ATGGCAGCCACAGCAAGGG | |
| | | GGTGTACATTCTCAGTGC | ATACTACGCAGAGCTCCGTG | | CTAGTAGCAACTGCAAC | GGACGGGATCCCTGATCGCT | |
| | | AGCTGGTGAGGTCTGGGGG | AAGGGCCGATTCACCATCT | | CGGTTCTCTCTCCCAGCC | TCTCAGGCTCCAGCTCTGGG | |
| | | AGGCTGGTCCAGCCTGGG | CCAGAGACAATTCCAAGAA | | TGTCTGACTCAATGCC | GCTGAGCGCTACCTCCACCAT | |
| | | AGTCCCTGAGACTCTCCT | CACGCTGTATCTGCAAATG | | CTCTGCCTCTGCCTCCCT | CTCCAGCCTCCAGTCTGAGG | |
| | | GTGCAGCCTCTGGATTCAC | AACAGCCTGAGAGCTGAGG | | GGGGAGCTCGGTCAAGC | ATGAGGCTGACTATTACTGT | |
| | | CTTCAGTAACTATGCTATGC | ACACCGGCTATTTATTACTGT | | TCACCTGCACTCTGAGCA | CAGACCTGGGGCACTGGCA | |
| | | ACTGGGTCCGCCAGGCTCC | GCGAGTGGATATACTGGCT | | GTGGGCACAGCAGCTAC | TTCTCGTATTCGGCGGAGGG | |
| | | AGGCAAGGGCTGGAGTGG | ACGATTATTTTGTGCGGGG | | GCCATCGCATGGCATCA | ACCAAGCTGACCGTCCTAG | |
| | | GTGGCAGTTATATCATATG | GGACTACTACGGTCTGGAC | | GCAGCAGCCAGAGAGG | (SEQ ID NO: 3469) | |
| | | ATGGAAGCAATAAATACTA | GTCTGGGCCAAGGGACCA | | GCCCTCGGTACTTGATGA | | |
| | | CGCAGACTCCGTGAAGGGC | CGGTCACCGTCTCCTCA | | AGTTAACACTGATGGC | | |
| | | CGATTCACCATCTCCAGAG | (SEQ ID NO: 3467) | | AGCCACAGCAAGGGGGA | | |
| | | ACAATTCCAAGAACACGCT | | | CGGGATCCCTGATCGCTT | | |
| | | GTATCTGCAAATGAACAGC | | | CTCAGGCTCCAGCTCTGG | | |
| | | CTGAGAGCTGAGGACACGG | | | GGCTGAGCGCTACCTCA | | |
| | | CTATTTATTACTGTGCGAGT | | | CCATTCTCCAGCCTCCAGT | | |
| | | GGATATACTGGCTACGATT | | | CTGAGGATGAGGCTGAC | | |
| | | ATTTTGTCGGGGGACTA | | | TATTACTGTCAGACCTGG | | |
| | | CTACGGTCTGGACTCTGG | | | GGCACTGGCATTCTCGTA | | |
| | | GGCCAAGGGACCACGGTCA | | | TTCGGCGGAGGGACCAA | | |
| | | CCGTCTCCTCAGGTCGACC | | | GCTGACCGTCCTAGGTC | | |
| | | AAGGGCCCATCGGTCTTCC | | | AGCCCAAGGCTGCCCC | | |
| | | CCCTGGCACCCTCCTCCAA | | | TCGGTCACTCTGTTCCCG | | |
| | | GAGCACCTTCTGGGGCACA | | | CCCTCGAGTGAGGAGCT | | |
| | | GCGGCCCTGGGCTGCCTGG | | | TCAAGCCAACAAGGCCA | | |
| | | TCAAGGACTACTTCCCCGA | | | CACTGGTGTGTCTCATAA | | |
| | | ACCTGTGACGGTCTCGTGG | | | GTGACTTCTACCCGGGA | | |
| | | AACTCAGGCGCCCTGACCA | | | GCCGTGACAGTGGCCTG | | |
| | | GCGGCGTGCACACCTTCCC | | | GAAGGCAGATAGCAGCC | | |
| | | GGCTGTCCTACAGTCCTCA | | | CCGTCAAGGCGGGAGTG | | |
| | | GGACTCTACTCCCTCAGCA | | | GAGACCACCACACCCTC | | |
| | | GCGTGGTGACCGTGCCCTC | | | CAAACAAAGCAACACA | | |
| | | CAGCAGCTTGGGCACCCAG | | | AGTACGGCCAGCAGC | | |
| | | ACCTACATCTGCAACGTGA | | | TACCTGAGCCTGACGCCT | | |
| | | ATCACAAGCCCAGCAACAC | | | GAGCAGTGNAAGTCCCA | | |
| | | CAAGTGGACAAGAGAGTT | | | CAGAAGCTACAGCTGCC | | |
| | | GAACCCAAATCTTGTGACA | | | AGGTCACGCATGAANGG | | |
| | | AAACTCACATGCCCACC | | | AGCACCTGTGAGAAGAC | | |
| | | GTGCCCAGCACCTGAACTC | | | AGTGCCCCTACAGAAT | | |
| | | CTGGGGGACCGTCAGTCT | | | GTTCATAGAAGCTTGGG | | |
| | | TCCTCTTCCCCCCAAAACCC | | | CCGCATGNCCAACTT | | |
| | | AAGGACACCCTCATGATCT | | | GTTTATTGCAGCTTATAA | | |
| | | CCCGACCCCTGAGGTNNC | | | TGGTTACAATAAAGCA | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | ATGCTGGN TABLE 15-continued Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | miniprep sequence | original nt sequence | sequence ID (plate/well) |
| | | CGAGAGCCAATCATGAAAC AACTATGGACACTTACTAC TACTACTACATGACG TCTGGGGCAAAGGACCAC GGTCACCGTCTCCTCAGCGT CGACCAAGGGCCCATCGGT CTTCCCCCTGGCACCCTCT CCAAGAGCACCTCTGGGGG CACAGCGGCCCTGGGCTGC CTGGTCAAGGACTACTTCC CCGAACCTGTGACGGTCTC GTGGAACTCAGGCGCCCTG ACCAGCGGCGTGCACACCT TCCCGGCTGTCCTACAGTCC TCANGACTTCTACTCCCTCAG CAGCGTGGTGACCGTGCCC TCCAGCAGCTTGGGCACCCG AGACCTACATCTGCAACGT GAATCACAAGCCCAGCAAC ACCNANGTGGACAAGAGAG TTGAGCCCAAATCTTGTGA CAAAACTCACACATGCCCA CCGTCCCCAGCACCTGAAC TCCTGGGGGACCGTCAGT ACATGCGTGNNGNNGACG TGAGCCACGAANACCCTGA NNCAAGTTCAACTGGNACN TNNNGGNNNNNNNGNGACT NANGNNANANAAGCNNN NGGGAGGANCANNANNAA CAGCNNNNNACCNNNGNN NGNCNNNCNNNCCNTCACC NN (SEQ ID NO: 3470) | | | CGAGGCTGATTATTACTG CAGTCATACACAAGCA GCAGCACTTCTGTGTGT TCGGCGGAGGGACCCAG CTGACCGTCCTAGGTCA GCCCAAGGCTGCCCCCT CGGTCACTCTGTTCCGC CCTCCAGTGAGGAGCTT CAAGCCAACAAGGCCAC ACTGGTCTGTCTCATAAG TGACTTCTACCGGGAG CCGTGACAGTGGCCTGG AAGGCAGATAGCAGCCC CGTCAAGGCGGGAGTGG AGACCACCACCCTCC AAACAAAGCAACAACAA GTACGCGGCCAGCAGCT ACCTGAGCCTGACGCCT GAGCAGTGAAGTCCCA CAGAGCTACAGCTGC AGTGTCACGCATGAAGGG AGCACCGNGNGAAGAC AGTGGCCCCTACAGAAT GTTCATAGAAGCTTGGN CGCCATGGCCCAACTTGT TTATTGCAGCTTATAATG GTTACAAATAAAGCAAT AGCATCACAAATTTCAC AAATAANCATTTTTTTCA CTGCATNTANTCGNNGNT NNTCCAAACTCATCNAT GNATNTNTCATGTCTGG NTCGGGNANTNANTCGN NNNNAGCANNATNN (SEQ ID NO: 3472) | |
| V-C020 | | NNNNNNNNNATGNNTCNA CACATACGATTTAGGTGAC ACTATAGAATAACATCCAC TTTGCCTTTCTCTCCACAGG TGTCCACTCCCAGGTCCAA CTGCACCTCGGTTCTATCGA TTGAATTCCACCATGGGAT GGTCATGTATCATCCTTTTT | GAGGTGCAGCTGGTGGAGT CTGGAGGAGGCTTGATCCA GCCTGGGGGGTCCCTGAGA CTCTCCTGTGCAGCCTCTGG GTTCACCGTCAGTAGCAAC TACATGACCTGGGTCCGCC AGGCTCCAGGGAAGGGGCT GGAGTGGGTCTCACTTATT | COV107_P2_C8 | NNNNNNNNNTATGNAT CNTACACAGTATATTTA GGTACACTATAGAATA ACATCCACTTGCCTTTC TCTCCACAGGTGTCCACT CCCAGGTCCAACTGCAC CTCGGTTCTATCGATTGA ATTCCACCATGGATGG | GACATCCAGATGACCCAGTC TCCATCTCCCTGTCTGCAT CTGTAGGAGACAGAGTCAC CATCACTTGCCAGGCGAGTC AGGACATTAGCAAGTATTTA AATTGGTATCAGCAGAAAC CAGGGAAAGCCCCTAAGCT CCTGATCTACGATGCATCCA | COV107_P2_C8 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | CTAGTA

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | NNNNNANNNNNNNNNNN NGNGGANNGNNNNGNNNG TNNNTNNNNCNNNNNNNNC NNNGNNNNNNNNTNNNNN NNNCNNGTNNNNNNGNNA NNNCNNNCNCCGTCNGCNC NNACTNNNNN (SEQ ID NO: 3474) | | | AGCATTTTTTCACTGCA TTCTAGTTGNNGTTTGTC CAAACTCATCAATGTATC TTATCATGTCTGGATCGG GNATNNNCGGCGCAGCA NCATGGCCTGAANNNAC CTNNGAAGANGANNNNG NNAGGNACTNNNTGAGN NNNN (SEQ ID NO: 3476) | | |
| V-C021 | | NNNNNNNNNNATGNATCA TACACATACGATTTAGGTG ACACTATAGAATAACATCC ACTTTGCCTTTCTCTCCACA GGTGTCCACTCCCAGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGTCTGGCAGTCTGGGG CTGAGGTGAAGAAGCCTGG GGCCTCAGTGAAGGTCTCC TGCAAGGCTTCTGGATACA CCTTCACCGGCTACTATATG CACTGGGTGCGACAGGCCC CTGGACAAGGGCTTAGTG GATGGGATGGATCAGCCCT GTCAGTGGTGGCACAAACT ATGCACAGAAGTTTCAGGG CAGGTCACCATGACCAGG GACACGTCCATCAGCACAG CCTACATGGAGCTGAGCAG GCTGAGATCTGAATTCTGTGCGA GAGCCCACTGTTCCCCAC AGGGGTGCTAGCTGGGAC TACTACTACGGTATGG ACGTCTGGGGCCAAGGGAC CACGGTCACCGTCTCCTCA GCGTCGACCAAGGGCCCAT CGGTCTTCCCCCTGGCACCC TCCTCCAAGAGCACCTCTG GGGGCACAGCGGCCCTGGG | CAGGTGCAGCTGGTGCAGT CTGGGGCTGAGGTGAAGAA GCCTGGGGCCTCAGTGAAG GTCTCCTGCAAGGCTTCTGG ATACACCTTCACCGGCTACT ATATGCACTGGGTGCGACA GGCCCCTGGACAAGGGCTT GAGTGGATGGGATGGATCA GCCCTGTCAGTGGTGGCAC AAACTATGCACAGAAGTTT CAGGGCAGGGTCACCATGA CCAGGGACACGTCCATCAG CACGCCTACATGGAGCTGA GCAGGCTGAGATCTGACG ACACGCCGTGTATTACTG TGCGAGAGCCCCACTGTTC CCACAGGGGTGCTAGCTG GGGACTACTACTACGG TATGGACGTCTGGGGCCAA GGGACCACGGTCACCGTCT CCTCA (SEQ ID NO: 3479) | COV107_ P2_H10 | NNNNNNNNNATGTATC NTACACATACGATTTAG GTGACACTATAGAATAA CATCCACTTTGCCTTTCT CTCCACAGGTGTCCACTC CCAGGTCCAACTGCACC TCGGTTCTATCGATTGAA TTCCACCATGGGATGGTC ATGTATCATCCTTTTTCT AGTAGCAACTGCAACCG GTTCCTGGGCCCCAGTCTG CCCTGACCACCTGCCCT CCGTGTCTGGGTCTCTG GACAGTCGATCACCATC TCCTGCACTGGAACCAG CAGTGATGTTGGGAGTT ATAACCTTCTCTCCTGGT ACCAACAGCACCCCAGGC AAAGCCCCAAACTCAT GATTTATGAGGGCAGTA AGCGGCCCTCAGGGGTT TCTAATCGCTTCTCTGGC TCCAAGTCTGGCAACAC GGCCTCCCTGACAATCTC TGGACTCCAGGCTGAGG ACGAGGCTGATTATTACT GCTGCTCATATGCAGGT AGTAGCACTTTGGTATTC GGCGGAGGGACCAAGCT GACCGTCCTAGGTCAGC CCAAGGCTGCCCCCTCG TCGACTCTGTTCCCACCC TCGAGTGAGGAGCTTCA AGCCAACAAGGCCACAC | CAGTCTGTGCTGACTCAGCC TGCCTCCGTGTCTGGGTCTC CTGGACAGTCGATCACCATC TCCTGCACTGGAACCAGCAG TGATGTTGGGAGTTATAACC TTGTCTCCTGGTACCAACAG CACCCAGGCAAAGCCCCCA AACTCATGATTTATGAGGGC AGTAAGCGGCCCTCAGGGG TTTCTAATCGCTTCTCTGGCT CCAAGTCTGGCAACACGGC CTCCCTGACAATCTCTGGAC TCCAGGCTGAGGACGAGGC TGATTATTACTGCTGCTCAT ATGCAGGTAGTAGCACTTTG GTATTCGGCGGAGGGACCA AGCTGACCGTCCTAG (SEQ ID NO: 3481) | COV107_ P2_H10 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CTGCCTGGTCAAGGACTAC TABLE 15-continued Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | ACCGTCAGTAGCAACTACA TGAGCTGGGTCCGCCAGGC TCCAGGAAGGGCTGGAG TGGGTCTCAGTTCTTTATAG CGGTGGTAGCTCATTCTAC GCAGACTCCGTGAAGGGCC GATTCACCACATCTCCAGAGA CAATTCCAAGAACACGCTG TATCTTCAAATGAACAGCC CGTGTATTACTGTGCGAGA GAAAGTGGGGATACAACTA TGGCCTTTGACTACTGGGG CCAGGGAACCCTGGTCACC GTCTCCTCAGCGTCGACCA AGGGCCCATCGGTCTTCCC CCTGCACCCTCCTCCAAG AGCACCTCTGGGGGCACAG CGGCCCTGGGCTGCCTGGT CAAGGACTACTTCCCCGAA CCTGTGACCGTCTCGTGGA ACTCAGGCGCCCTGACCAG CGGCGTGCACACCTTCCCG GCTGTCCTACAGTCCTCAN GACTCTACTCCCTCAGCAG CGTGTGACCGTGCCCTCC AGCAGCTTGGGCACCCAGA CCTACATCTGCAACGTGAA TCACAAGCCCAGCAACACC AAGGTGGACAAGANAGTTG AGCCCAAATCTTGTGACAA AACTCACACATGCCACCG TGCCCAGCACCTGAACTCC TGGGGGACCGTCAGTCTT CCNCNTCCCCCAAAACCC AAGGACACCCTCATGATCT CCNGGACCCCNGAGGTCAC ATGCGNNGGTGGNTGGNNG NGAGCCACGANNANCCTGA GGTCAAGTTCAACTGGNAC GTGGACGGNNGNGNNN NCATAATGCCAAGACCCAAA GCNN (SEQ ID NO: 3482) | CGGCCGTGTATTACTGTGC GAGAGAAAGTGGGGATACA ACTATGGCCTTTGACTACTG GGGCCAGGGAACCCTGGTC ACCGTCTCCTCAG (SEQ ID NO: 3483) | | ATCACTTGCCGGGCCAG TCAGGGCATTAGCAGTT ATTTAGCCTGGTATCAGC AAAAACCAGGGAAAGCC CCTAAGCTCCTGATCTAT GCTGCATCCACTTTGCAA AGTGGGGTCCCATCAAG GTTCAGCGGCAGTGAT CTGGGACAGAATTCACT CTCACAATCAGCAGCCT GCAGCCTGAAGATTTTG CAACTTATTACTGTCAAC AGCTTAATAGTGACTCGT ACACTTTTGGCCAGGGG ACCAAGCTGGAGATCAA ACGTACGGTGGCTGCAC CATCTGTCTTCATCTTCC CGCCATCTGATGAGCAG AGTGGGGTCCCATCAAG TTGAAATCTGGAACTGC CTCTGTTGTGTGCCTGCT GAATAACTTCTATCCCAG AGAGGCCAAAGTACAGT GGAAGGTGGATAACGCC CTCCAATCGGGTAACTCC CAGGAGAGTGTCACAGA GCAGGACAGCAAGGACA GCACCTACAGCCTCAGC AGCACCCTGACGCTGAG CAAAGCAGACTACGAGA AACACAAAGTCTACGCC TGCGAAGTCACCCATCA GGGCCTGAGCTCGCCCG TCACAAAGAGACTTCAAC ANGGGGANANTGTNANA ANCTNGGCCGCNNNNNG NCCACNTTGTNTNTNGN GNCNNNNTNNTANNNTGN NNACAAATANAACANAT CATCANNNNTTTTTNNNA ANANNNTTTTTNNNN CAGNCNAGNGNGNTTG GTNNNNNTNNTCATNNN NNNANNNNTGNCTGNAT GGATNANNNNNNCNNN NNNNNNNNNNNN | AGTGACTCGTACACTTTTGG CCAGGGGACCAAGCTGGAG ATCAAAC (SEQ ID NO: 3485) |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C023 | NNNNNNNNNNTANNNNN TCNTACNNATACGATTTAG GTGACACTATAGAATAACA CCACTTTGCCTTTCTCTCC ACAGGTGTCCACTCCAGG TCCAACTGCACCTCCGTTCT ATCGATTGAATTCCACCAT GGGATGGTCATGTATCATC CTTTTTCTAGTAGCAACTGC ATAGCGGTGTAGCACATA CTACCCAGACTCCGTGAAG GTGCAGCTGGTGAGTCTG GAGGAGGCTTGATCAGCC TGGGGGGTCCCTGAGACTC TCCTGTGCAGCCCTCTGGGT CACCGTCAGTAGGAACTAC ATGAGCTGGGTCCGCCAGG CTCCAGGGAAGGGGCTGGA GTGGGTCTCAGTTATTTATA GCGGTGGTAGCACATACTA CGCCAGACTCCGTGAAGGGC CGATTCACCATCTCCAGAG ACAATTCCAAGAACACGCT GTATCTTCAAATGAACAGC CTGAGAGCCGAGGACACGG CCGTGTATTACTGTGCGAG AGATCTATCTGCTTTTTG ATATCTGGGGCCAAGGGAC AATGGTCACCGTCTCTTCAG CGTCGACCAAGGGCCCATC GGTCTTCCCCTGGCCACCCT CCTCCAAGAGACACCTCTGG GGGCACAGCGGCCCTGGGC TGCCTGGTCAAGGACTACT TCCCCGAACCTGTGACGGT CTCGTGGAACTCAGCGCC CTGACCAGCGGCGTGCACA CCTTCCCGGCTGTCCTACAG TCCTCAGGACTCTACTCCCT CAGCAGCGTGGTGACCGTG | GAGGTGCAGCTGGTGGAGT CTGGAGGAGGCTTGATCCA GCCTGGGGGGTCCCTGAGA CTCTCCTGTCAGCCTCTGG GGTCACCGTCAGTAGGAAC TACATGAGCTGGGTCCGCC AGGCTCCAGGGAAGGGGCT GGAGTGGGTCTCAGTTATT TATAGCGGTGTAGCACATA CTACCCAGACTCCGTGAAG GGCCGATTCACCATCTCCA GAGACAATTCCAAGAACAC GCTGTATCTTCAAATGAAC AGCCTGAGAGCCGAGGACA CGGCCGTGTATTACTGTGC GAGAGATCTATCTGCTTT TGATATCTGGGGCCAAGG GACAATGGTCACCGTCTCT TCAG (SEQ ID NO: 3487) | COV107_P1_B6 | AACTANNNTNNNANNA NNTANNTNNNTANNTNC NNNNNNANGANGAANN N (SEQ ID NO: 3484) NNNNNNCNNNTGNATC NTACACATACGATTTAG GTGACACTATAGAATAA CATCCACTTTGCCTTTCT CTCCACAGGTGTCCACTC CCAGGTCCAACTGCACC TCGTTTCATCGATTGAA TTCCACCATGGGATGGTC ATGTATCATCCTTTTTCT AGTAGCAACTGCAACCG GTGTACATTCAGACATCC AGTTGACCCAGTCTCCAT CCTTCCTGTCTGCATCTG TAGGAGACAGAGTCACC ATCACTTGCCGGGCCAG TCAGGCATTAGCAGTT ATTTAGCCTGGTATCAGC AAAAACCAGGGAAAGCC CCTAAGCTCCTGATCTAT GCTGCATCCACTTTGCAA AGTGGGGTCCCATCAAG GTTCAGCGGCAGTGGAT CTGGGACAGAATTCACT CTCACAATCAGCAGCCT GCAGCTGAAGATTTTG CAACTTATTACTGTCAAC AGCTTAATAGTTACCCTC CAGCCTTCGGCCAAGGG ACACGACTGGAGATTAA ACGTACGGTGGCTGCAC CATCTGTCTTCATCTTCC CGCCATCTGATGAGCAG TTGAAATCTGGAACTGC CTCTGTTGTGTGCCTGCT GAATAACTTCTATCCAG AGAGGCCAAAGTACAGT GGAAGGTGGATAACGCC CTCCAATCGGGTAACTCC CAGGAGAGTGTCACAGA | GACATCCAGTTGACCCAGTC TCCATCCTTCCTGTCTGCAT CTGTAGGAGACAGAGTCAC CATCACTTGCCGGGCCAGTC AGGGCATTAGCAGTTATTTA GCCTGGTATCAGCAAAAAC CAGGGAAAGCCCCTAAGCT CCTGATCTATGCTGCATCCA CTTTGCAAAGTGGGGTCCCA TCAAGGTTCAGCGGCAGTG GATCTGGGACAGAATTCACT CTCACAATCAGCAGCCTGCA GCCTGAAGATTTTGCAACTT ATTACTGTCAACAGCTTAAT AGTTACCCTCCAGCCTTCGG CCAAGGGACACGACTGGAG ATTAAAC (SEQ ID NO: 3489) | COV107_P1_B6 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCCTCCAGCAGCTTGGGCA CCCAGACCTACATCTGCAA CGTGAATCACAAGCCCAGC AACACCAAGTGACAAGA GAGTTGAGCCCAAATCTTG TGACAAAACTCACACATGC CCNCCGTGCCCAGCACCTG NACTCCTGGGGGNNNNTCA GTCTTNNNCTNNNCCCCAA AANCCNNNGNNNNCCNCNN NNNNTCCNCNANNCCNNNN GNCCCANNNGNGNNNNN NNNNNNGNCCNNGAACCN NCNNNNNNNNNNNNNNN GTTNNNNGGNNCNTGGANN GNNNNNANGNNNNNAT GNCNNANNAGNCNNNGNA NNNCANTACANNNGNNCGT ACNNNNNGNCAGCGTCNTC NCGTCNTGCACNNACTGG NNNANNGNNN (SEQ ID NO: 3486) | | | GCAGGACAGCAAGGACA GCACCTACAGCCTCAGC AGCACCCTGACGCTGAG CAAAGCAGACTACGAGA AACACAAAGTCTACGCC TGCGAAGTCACCCATCA GGGCCTGAGCTCGCCG TCACAAAGAGCTTCAAC AGGGAGAGTGTTAGAA GCTTGGNCCCCCATGGC CCAACTTGTTTATTGCAG CTTATAATGGTTACAAAT AAGCAATAGCATCACA AATTTCACAAATAAAGC ATTTTTTCACTGCATTC TANTTGNNGTTTGTCCAA NCTCATCAATGTATNTNN CATGTCTGGNTCGGGAA TTNNNNNNGCAGCNCNT NNNTGAANNACNNTGAA NAGNNTTGNNNNGTACC TTCTGAGNGAANNNNTC TNNNGANN (SEQ ID NO: 3488) | | |
| V-C024 | NNNNNNNNTATGTATNNTA CACATACGATTTAGGTGAC ACTATAGAATAAACATCAC TTTGCCTTTCTCTCCACAGG TGTCCACTCCAGGTCCAA CTGCACCTCCGGTTCTATCGA TTGAATTCCACCATGGGAT GGTCATGTATCATCCTTTT CTAGTAGCAACTGCAACCG GTGTACATTCTGAGGTGCA GGCTTGGTACAGCCTGGG GGTCCCTGAGACTCTCCTGT CAGCCCTCTGGATTCACCTT CAGTGGCTATAGCATGAAC | GAGGTGCAGCTGGTGAGT CTGGGGGAGGCTTGGTACA GCCTGGGGGTCCCTGAGA CTCTCCTGTGCAGCCCTCTGG ATTCACCTTCAGTGGCTATA GCATGAACTGGGTCCGCCA GGCTCCAGGGAAGGGGCCG GAGTGGGTTTCATACATTA GTAGGAGTAGTAGTACCAT ATACTACGCAGACTCTGTG AAGGGCCGATTCACCATCT CCAGAGACAATGCCAAGAA CTCACTGTATCTGCAAATG AACAGCCTGAGAGACGAGG ACACGGCTGTGTATTACTGT | COV107_P1_A2 | NNNNNNNNNNNTC NTACACATACGATTTAG GTGACATAGAATAA CATCCACTTTGCCTTTCT CTCCACAGGTGTCCACTC CCAGGTCCAACTGCACC TCGGTTCTATCGATGAA TTCCACCATGGGATGGTC ATGATCATCCTTTTTCT AGTAGCAACTGCAACCG GTGTACATTCAGAAATT GTGTTGACACAGTCTCCA GCCACCCTGTCTTTGTCT CAGGGGAAAGAGCCAC CCTCTCCTGCAGGGCCA | GAAATTGTGTTGACACAGTC TCCAGCCACCCTGTCTTTGT CTCCAGGGGAAAGAGCCAC CCTCTCCTGCAGGGCCAGTC AGAGTTTTAGCAGCTACTTA GCCTGGTACCAACAGAAAC CTGGCCAGGCTCCCAGGCTC CTCATCTATGATGCATCCAA CAGGGCCACTGGCATCCCA GCCAGGTTCAGTGGCAGTG GGTCTGGGACAGACTTCACT CTCACCATCAGCAGCCTAGA GCCTGAAGATTTTGCAGTTT ATTACTGTCAGCAGCGTAAC AACTGGCCTCCCGAGTGGAC | COV107_P1_A2 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | TGGGTCCGCCAGGCTCCAGGGAAGGGGCCGGAGTGGGTTTCATACATTAGTAGGAGTAGTAGTACCATATACTACGCAGACTCTGTGAAGGGCCGATTCACCATCTCCAGAGACAATGCCAAGAACTCACTGTATCTGCAAATGAACAGCCTGAGAGACGAGGACACGGCTGTGTATTACTGTGCGAGAGAAGGGGCTAGAGTGGGAGCTACATATGACACGTACTACTTTGACTACTGGGGCCAGGGAACCCTGGTCACCGTCTCCTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCTGTGACGGTCTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAGAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGNNNCACATGCGTGGTGGTGGNCGTGAGCCACGANACCCTGNNNCAAGTTCAACTGGTACGNNGNCGGGCGNNGAGGTGCATNATGCCAANANAAGCCGCGGGNAGGAGCAGTANAACAGCNCGTACCGNNNNNGNNAGNNN (SEQ ID NO: 3490) | GCGAGAGAAGGGGCTAGAGTGGGAGCTACATATGACACGTACTACTTTGACTACTGGGGCCAGGGAACCCTGGTCACCGTCTCCTCAG (SEQ ID NO: 3491) | | GTCAGAGTTTTAGCAGCTACTTAGCCTGGTACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGACTTCACTCTCACCATCAGCAGCCTAGAGCCTGAAGATTTTGCAGTTTATTACTGTCAGCAGCGTAACAACTGGCCTCCCGAGTGGACGTTCGGCCAAGGGACCAAGGTGGAAATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAGAAGCTTGGCCGCCATGGCCCAACTTGTTTATTGCAGCTTATAATGGTTACAAATAAAGCAATAGCATCACAAATTTCACAAATAAAGCATTTTTTTCACTGCATTCTAGTTGTGGTTTGTCCAAACTCATCAATGTATCTTATCATGTCTGGATCGGGAANTAATTNNNGCANCANCATGGNNTGAAATAACCTCTGAAANANA | GTTCGGCCAAGGGACCAAGGTGGAAATCAAAC (SEQ ID NO: 3493) | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| V-C025 | NNNNNNNNNATGTATCAT ACACATACGATTTAGGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACAATTCCCAGGTGC AGCTGGTGCAGTCTGGGCC TGAGGTGAAGAAGCCTGGG ACCTCAGTGAAGGTCTCCT GCAAGGCTTCTGGATTCAC CTTTACTAGTCTCTGCTGTGC AGTGGGTGCGACAGGCTCG TGGACAACGCCTTGAGTGG ATAGGATGGATCGTCGTTG GCACAGGTAACACAAACTA CGCACAGAAGTTCCAGGAA AGAGTCACCATTACCAGGG ACATGTCCAAGCACAGC CTACATGGAGCTGAGCAGC CTGAGATCCGAGGACACGG CCGTGTATTACTGTGCGC ACCTTATTGTAGTGGTGGTA GCTGCTCTGATGCTTTTGAT ATCTGGGGCCAAGGGACAA TGGTCACCGTCTCTTCAGCG TGACCAAGGGCCCATCGG TCTTCCCCCTGGCACCCTCC TCCAAGAGCACCTCTGGGG GCACAGCGGCCCTGGGCTG CCCTGGTCAAGGACTACTTC CCCGAACCTGTGACGTCT CGTGGAACTCAGGCGCCT GACCAGCGGCGTGCACACC CTCCCGGCTGTCTACTCCTCA CTCAGGACTCTACTCCCTCA GCAGCGTGGTGACCGTGCC | CAAATGCAGCTGGTGCAGT CTGGGCCTGAGGTGAAGAA GCCTGGGACCTCAGTGAAG GTCTCCTGCAAGGCTTCTGG ATTCACCTTTACTAGCTCTG CTGTGCAGTGGGTGCGACA GGCTCGTGGACAACGCCCT GAGTGGATAGGATGGATCG TCGTTGGCAGTGGTAACAC AAACTACGCACAGAAGTTC CAGGAAAGAGTCACCATTA CCAGGGACATGTCCAAGAG CACAGCCTACATGGAGCTG AGCAGCCTGAGATCCGAGG ACACGGCCGTGTATTACTG TGCGGCACCTTATTGTAGTG GTGGTAGCTGCTCTGATGCT TTTGATATCTGGGGCCAAG GGACAATGGTCACCGTCTC TTCAG (SEQ ID NO: 3495) | COV107_P2_G9 | ACTTGGNNNGGTACCTN CTGNANGCCGAAANAAN CATCNNNN (SEQ ID NO: 3492) NNNNNNNNNCNNTANGTA TCATACACATAACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTGTACATTCAGAAA TTGTGTTGACGCAGTCTC CAGGCACCCTGTCTTTGT CTCCAGGGGAAAGAGCC ACCCTCTCCTGCAGGGCC AGTCAGAGTGTTAGCAG CAGTACTTAGCCTGGTA CCAGCAGAAACCTGGCC AGGCTCCCAGGCTCCTC ATCTATGGTGCATCCAGC AGGGCCACTGGCATCCC AGACAGGTTCAGTGGCA GTGGGTCTGGGACAGAC TTCACTCTCACCATCAGC AGACTGGAGCCTGAAGA TTTTTGCAGTGTATTACTG TCAGCAGTATGGTAGCT CACCCTGGACGTTCGGC CAAGGGACCAAGGTGGA AATCAAACGTACGGTGG CTGCACCATCTGTCTTCA TCTTCCCGCCATCTGATG AGCAGTTGAAATCTGGA ACTGCCTCTGTTGTGTGC CTGCTGAATAACTTCTAT CCCAGAGAGGCCAAAGT ACAGTGGAAGGTGGATA ACGCCCTCCAATCGGGT AACTCCCAGGAGAGTGT CACAGAGCAGGACAGCA | GAAATTGTGTTGACGCAGTC TCCAGGCACCCTGTCTTTGT CTCCAGGGGAAAGAGCCAC CCTCTCCTGCAGGGCCAGTC AGAGTGTTAGCAGCAGTTA CTTAGCCTGGTACCAGCAGA AACCTGGCCAGGCTCCCAG GCTCCTCATCTATGGTGCAT CCAGCAGGGCCACTGGCAT CCCAGACAGGTTCAGTGGC AGTGGGTCTGGGACAGACTT CACTCTCACCATCAGCAGAC TGGAGCCTGAAGATTTTGCA GTGTATTACTGTCAGCAGTA TGGTAGCTCACCGTGGACGT TCGGCCAAGGGACCAAGGT GGAAATCAAAC (SEQ ID NO: 3497) | COV107_P2_G9 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CTCCAGCAGCTTGGGCACC CAGACCTACATCTGCAACG TGAATACAAGCCCAGCAA CACCNNGTGGACAAGAGAG TTGAGNCCAAATCNTGTGN NNAACTNANACNTNNNCNN NCCNNCNNGNCCAGNACCN NNNNNNCGGGGGGNNN NNNNCATTNNNNNNNNNNN NNAAACCCAGGGACNCCCT CANTGATCTCCNNNNNCCC NNGANGTCACNTGNNGTGG TGGTGNNCGTGANCCANNA NANNNGNNNCANTNAACTN NNCGTGNNGNNNTNNNNTG CATANGCANANNNCNCGGG ANGNNCANTANACAGCNCG TACGNGNNGNCANNNTCNT CNNNGNCNN (SEQ ID NO: 3494) | | | AGGACAGCACCTACAGC CTCAGCAGCACCCTGAC GCTGCAGCAAAGCAGACT ACGAGAAACACAAAGTC TACGCCTGCGAAGTCAC CCATCAGGGCCTGAGCT CGCCCGTCACAAAGAGC TTCAACAGGGGAGAGTG TTAGAAGCTTGGCCGCC ATGGCCCAACTTGTTTAT TGCAGCTTATAATGTTTA CAAATAAAGCAATAGCA TCACAAATTTCACNATA AAGCATTTTTTTCACTGC ATTCTANTTGTGGTTTGT CCANCTCATCAATGTATC TNATCATGTCTGATCGG GANTNANTNNNGCAGCA NCATGGNNTGAAATACN TCTGAANNAGGANTTGG NTANGTACCTNNNGAGN GAANNNANCATNNNNNG N (SEQ ID NO: 3496) | | |
| V-C026 | NNNNNNNNNNCNNNNTGT ATCNTACACATACGATTTA GGTGACACTATAGAATAAC ATCCACTTTGCCTTTCTC CACNNNNNCCACTCCCAG GTCCAACTGCACCTCGGTTC TATCGATTGAATTCCACCAT GGGATGGTCATGTATCATC CTTTTTCTAGTAGCAACTGC AACCGGTGTACATTCCCAG GTCCAGGACTGGAGGTCGG GCCCAGGACGTCCAAGAATCA TTCGGAGACCCTGTCCCTCT CCTGCGCTCTGCTCTGGTGGC TCCATCGGTAGTTACTTCTG GAGCTGGATCCGGCAGCCC CCAGGGAAGGGACTGGAGT GGATTGGATATCTCCATTAC AGTGGGAGCACCAACTACA ACCCCTCCCTGAAGAGTCG AGTCACCATATCAGTAGAC | CAGGTGCAGCTGCAGGAGT CGGGCCCAGGACTGGTGAA GCCTTCGGAGACCCTGTCC CTCTCCTGCGCTGTCTCTG TGGCTCCATCGGTAGTTACT TCTGGAGCTGGATCCGGCA GCCCCCAGGGAAGGGACTG GAGTGGATTGGATATCTCC ATTACAGTGGGAGCACCAA CTACAACCCCTCCCTGAAG AGTCGAGTCACCATATCAG TAGACACGTCCAAGAATCA TAGACAGCCTCCCTCCTCT GTTCTCCCTGAAAGCTGAGCT CTGTGACCGCTGCGACAC GGATTGCAGTGGCTACGCG AGATTGCAGTGGCTACGCG AGCTGGAAATCTGGGG CCAAGGGGACAATGGTCACC GTCTCTTCAG (SEQ ID NO: 3499) | COV107_P2_C4 | NNNNNNNNNNNNNTGTAT CNTACACATACGATTTA GGTGACACTATAGAATA ACATCCACTTTGCCTTTC TCTCCACAGGTGTCCACT CCCAGGTCCAACTGCAC CTCGGTTCTTATCGATTGA ATTCCACCATGGGATGGA TCATGTATCATCCTTTTTT CTAGTAGCAACTGCAAAC CGGTTCTGGGTCTGCTC CATCGACAGCTCCTCCAACT CTGCCTCCCTCACCATCTCT GGACTGAAGACTGAGGACG AGGCTGACTACTACTGTCAG TCTTATGATAGCAGCAATTT GGTATTCGGCGGAGGGACC AAGCTGACCGTCCTAG (SEQ ID NO: 3501) | COV107_P2_C4 |
| | | | | AATTTATGCTGACTCAGCC CCACTCTGTGTCGGAGTCTC CGGGGAAGACGGTAACCAT CTCCTGCACCGGCAGCAGTG GCAGCATTGCCAGCAACTAT GTGCAGTGGTACCAGAGC GCCCGGGCAGTGCCCCACC ACTGTGATCAATGAAGATA ACCAAAGACCCCTGGGGTC CCTGATCGGTTCTCTGCTC CATCGACAGCTCCTCCAACT CTGCCTCCCTCACCATCTCT GGACTGAAGACTGAGGACG AGGCTGACTACTACTGTCAG TCTTATGATAGCAGCAATTT GGTATTCGGCGGAGGGACC AAGCTGACCGTCCTAG (SEQ ID NO: 3501) | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | ACGTCCAAGAATCAGTTCT CCCTGAAGCTGAGCTCTGT GACCCCTGCGGACACGGCC GTGTATTACTGTGCGAGATT GCAGTGGCTACGCGGAGCT TTTGATATCTGGGGCCAAG GGACAATGGTCACCGTCTC TTCAGCGTCGACCAAGGGC CCATCGGTCTTCCCCCTGGC ACCCTCCTCCAAGAGCACC TCTGGGGGCACAGCGGCCC TGGGCTGCCTGGTCAAGGA CTACTTCCCCGAACCTGTGA CGGTCTCGTGGAACTTCAGG CGCCCTGACCAGCGGCGTG CACACCTTCCCGGCTGTCCT ACAGTCCTCNNACTCTACTC CCTCAGCAGCGTGGTGACC GTGCCCTCCAGCAGCTTGG GCACCCAGACCTACATCTG CAACGTGAATCACAAGCCC AGCAACACCAAGGTGGANN GAGAGTTGAGCCCAAATCT TGTGACAAAACTCACACAT GCCCACCGNNGCCCAGCACC TGACTCCTGGGGGGACCGT CAGTCTTCCTCTTCCCCCAA AACNCNNGGANNNCCCNNA TGATCTCCCNNANCCCTGA GNCACATGNNNNNNGGTGGG NGNNGTGAGCCACNANACC CNNGAGNTNAGTTCNANTT GGNNCCNNGNANGGCCNG NAGGNNNNNTTAATGNCANN NNNNAAGNNNN (SEQ ID NO: 3498) | | | CCTGATCGGTTCTCTGGC TCCATGAAGCTCCTCC AACTTGCCTCCCCTACC ATCTCTGGACTGAAGAC TGAGGACGAGGCTGACT ACTACTGTCAGTCTTATG ATAGCAGCAATTTGGTA TTCGGCGGAGGGACCAA GCTGACCGTCCTAGGTC AGCCCAAGGCTGCCCCC TCGGTCACTCTGTTCCCG CCCTCGAGTGAGGAGCT TCAAGCCAACAAGCCA CACTGGTGTGTCTCATAA GTGACTTCTACCCGGGA GCCGTGACAGTGGCCTG GAAGGCAGATAGCAGCC CCGTCAAGGCGGGAGTG GAGACCACCACCCTC CAAACAAAGCAACAACA AGTACGCGGCCAGCAGC TACCTGAGCCTGACGCCT GAGCAGTTGGAAGTCCCA CAGAAGCTACAGCTGCC AGTTCACGCATGNANGG GAGCACCGTGGAGAAGA CAGTGGCCCTACAGAA TGTTCATAGAAGCTTGGC CGCCATGGCCCAACTTGT TTATTGCAGCTTATAATG GTTACAAATAAAGCAAT AGCATCACAAATTTCAC AAATAAGCATTTTTTTCA CTGCATTCTAGTTGNNGG NTTGTCCAAACTCATCAA TGNNTCTNATCATGTCTG GATCGGGAATTNNNCGN NNAGCACCATNNNTNAA ANNACNTCTGAANAGNN NTGGTNAGGTACCTTCTN NNNNAAANAANCATCTN NNGNAANGN (SEQ ID NO: 3500) | | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C027 | NNNNNNNNNTATGNATN ATACACATACGATTAGGT GACACTATAGAATAACATC CACTTTGCCTTTCTCCAC AGGTGTCCACTCCCAGGTC CAACTGCACCTCGGTTCTAT CGATTGAATTCCACCATGG GATGGTCATGTATCATCCTT TTTCTAGTAGCAACTGCAA CCGGTGTACATTCCCAGGT GCAGCTGGTCAGTCTGGG GCTGAGGTGAAGAAGCCTG GGGCCTCAGTGAAGGTCTC CTGCAAGGCTTCTGGATAC ACCTTCACCGGCTACTATAT GCACTGGGTGCGACAGGCC CCTGGACAAGGGCTTGAGT GGATGGGATGGATCAACCC TAACAGTGGTGGCACAAAC TATGCACAGAAGTTTCAGG GCAGGGTCACCATGACCAG GGACACGTCCATCAGCACA GCCTACATGGAGCTGAGCA GGCTGAGATCTGACGACAC GGCCGTGTATTACTGTGCG ACGGCGCACCCCCGGAGGA TCCAGGGGTATTTTTTTTG GGGGCGGGCCTCTGGGGCC AAGGGACCACGGTCACCGT CTCCCAGCGTCGACCAAG GGCCCATCGGTCTTCCCCCT GGCACCCTCCTCCAAGAGC ACCTCTGGGGCACAGCGG CCCTGGGCTGCCTGGTCAA GGACTACTTCCCCGAACCT GTGACGGTCTCGTGGAACT CAGGCGCCCTGACCAGCGG CGTGCACACCTTCCCGGCT GTCCTACAGTCCTCANGAC TCTACTCCCTCAGCAGCGTG GTGACCGTGCCCTCCAGCA GCTTGGGCACCCAGACCTA CATCTGCAACGTGAATCAC AAGCCCAGCAACACCNAAG | CAGTGCAGCTGGTGCAGT CTGGGGCTGAGGTGAAGAA GCCTGGGGCCTCAGTGAAG GTCTCCTGCAAGGCTTCTGG ATACACCTTCACCGGCTACT ATATGCACTGGGTGCGACA GGCCCCTGGACAAGGGCTT GAGTGGATGGGATGGATCA ACCCTAACAGTGGTGGCAC AAACTATGCACAGAAGTTT CAGGGCAGGGTCACCATGA CCAGGGACACGTCCATCAG CACAGCCTACATGGAGCTG AGCAGGCTGAGATCTGACG ACACGGCCGTGTATTACTG TGCACGGCGCACCCCCGG AGGATCCAGGGGTATTTT TTTTGGGGCCGGGCCTCTG GGGCCAAGGGACCACGGTC ACCGTCTCCTCA (SEQ ID NO: 3503) | COV107_ P1_C3 | NNNNNNNNNNNNNNTC ATACACATACGATTAG GTGACACTATAGAATAA CATCCACTTTGCCTTCT CTCCACAGTGTCCACTC CCAGTCCAACTGCACC TCGGTTCTATCGATTGAA TTCCACCATGGGATGGTC TTGTATCATCCTTTTTCT AGTAGCAACTGCAACCG GTTCCTGGGCCCCAGTCTG TGCTGACTCAGCCACCCT CAGCCTCTGGGACCCCC GGGCAGAGGGTCACCAT CTCTTGTTCTGGAAGCAG CCAGTCCAACTGCACC GTAAACTGGTACCAGCA GCTCCCAGGAACGGCCCC CAAACTCCTCATCTATAG TAATAATCAGCGGCCCTCA GGGGTCCCTGACCGATTCT CTGGCTCCAAGTCTGGCAC CTCAGCCTCCCTGGCCAT CAGTGGGCTCCAGTCTGA GGATGAGGCTGATTATTAC TGTGCAGCATGGGATGAC AGCCTGAATGGCCTGGTAT TCGGCGGAGGGACCAAGCT GACCGTCCTAGGTCAGCC CAAGGCTGCCCCCTCGGT CACTCTGTTCCCACCCTCG AGTGAGGAGCTTCAACAA CAAGGCCACACACTGGTG TGTCTCATAAGTGACTTCT ACCCGGGAGCCGTGACAG TGGCCTGGAAGGCAGATA GCAGCCCCGTCAAGGCGG GAGTGGAGACCACCAAAC CCTCCAAAACAGCAGCAACA AGTACGCGGCCAGCAGCTA CCTGAGCCTGACGCCTGA GCAGTGGAAGTCCCACA (SEQ ID NO: 3505) | COV107_ P1_C3 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TGGACAAGANAGTTGAGCC<br>CAAATCTTGTGACAAAACT<br>CACACATGCCCACCGTGCC<br>CAGCACCTGAACTCCTGGG<br>GGGANCGTCAGTCTTCCTCT<br>TCCCCNAAANCCAANGA<br>CACCCTCATGATNTCCCNN<br>ACCCCTGAGGTCNNATNCG<br>TGGNNNNGNNGTGANCCA<br>CNANACCCNGANNCAGTTC<br>AACTGGNACNTNNNGGCGN<br>NNNNTGCANNANNCNANA<br>N (SEQ ID NO: 3502) | | | GAAGCTACAGCTGCCAG<br>GTCACGCATGAAGGAG<br>CACCGTGGAGAAGACAG<br>TGGCCCCTACAGAATGTT<br>CATAGAAGCTTGGCCGC<br>CATGCCCAACTTGTTTA<br>TTGCAGCTTATAATGGTT<br>ACAAATAAAGCAATAGC<br>ATCACAAATTTCACAAA<br>TAAAGCATTTTTTTCACT<br>GCATTCTANTTGTGTTT<br>GTCCAAACTCATCAATGT<br>ATCTTATCNTGTCTGGAT<br>CGGGAATTANTTCCGCG<br>CANCACCNTGGCCTGAA<br>TANCCTCTGAAANANA<br>ACTTGNNTANNGNACCT<br>TCTGNNNGNNANNTANN<br>NAANNNNNNAANNN<br>NGTCTNNNNNNNNNNNN<br>NGNNANNTNNNNNNNN<br>N (SEQ ID NO: 3504) | | |
| V-C028 | NNNNNNNNNTATGTATC<br>NTACACATACGATTAGGT<br>GACACTATAGAATAACATC<br>CACTTTGCCTTTCTCCAC<br>AGTGTCCACTCCCAGGTC<br>CAACTGCACCTCGGTTCTAT<br>CGATTGAATTCCACCATGG<br>GATGGTCATGTATCATCCTT<br>TTTCTAGTAGCAACTGCAA<br>CCGGTGTACATTCTGAGGT<br>GCAGGTGTTGGAGTCTGGG<br>GAGGCTTGGTACAGCCTG<br>GGGGGTCCCTGAGACTCTC<br>CTGTGCAGCCTCTGATTCA<br>CCTTTAGCACCTATGCCATG<br>AGTTGGGTCCGCCAGGCTC<br>CAGGGAAGGGGCTGGAGTG<br>GGTCTCAACTATTACTGGTA<br>CGGTCGTGACACATACTA<br>CGCAGACTCCGTGAAGGGC<br>CGGTTCACCATCTCCAGAG | GAGGTGCAGCTGTTGGAGT<br>CTGGGGGAGGCTTGGTACA<br>GCCTGGGGGGTCCCTGAGA<br>CTCTCCTGTGCAGCCTCTGG<br>ATTCACCTTTAGCACCTATG<br>CCATGAGTTGGGTCCGCCA<br>GGCTCCAGGGAAGGGGCTG<br>GAGTGGGTCTCAACTATTA<br>CTGGTAGTGCGTGACAC<br>ATACTACGCAGACTCCGTG<br>AAGGGCCGGTTCACCATCT<br>CCAGAGACAATTCCAAGAA<br>CACGCTGTTTCTGCAACTGA<br>ACAGCCTGAGAGCCGAGA<br>CGGCGGCCGTGTATTCTGTG<br>CGAACCACCCTCTGGCATC<br>AGGCGAAGGACTACTACCAC<br>TACTACATGGACGTCTGGG<br>GCAAAGGGACCACGGTCAC<br>CGTCTCCTCA (SEQ ID NO: 3507) | COVO72_P2_B12 | NNNNNNNNCNNNNNGTA<br>TCNTACACATACGATTTA<br>GGTGACACTATAGAATA<br>ACATCCACTTTGCCTTTC<br>TCTCCACAGGTGTCCACT<br>CCCAGGTCCAACTGCAC<br>CTCGGTTCTATCGATTGA<br>ATTCCACCATGGGATGG<br>TCATCTATCATCCTTTTT<br>CTAGTAGCAACTGCAAC<br>CGGTGTACATTCAGAAA<br>TTGTGTTGACGACAGTCTC<br>CAGGCACCCTGTCTTTGT<br>CTCCAGGGAAAGAGCC<br>ACCCTCTCCTGCAGGGCC<br>AGTCAGAGTGTTAACAG<br>CAGGCAGTTAGCCTGGT<br>ACCAGCAGAAACCTGGC<br>CAGGCTCCCAGGCTCCTC<br>ATCTATGGTGTCCAGC<br>AGGGCCACTGGCATCCC | GAAATTGTGTTGACGCAGTC<br>TCCAGGCACCCTGTCTTTGT<br>CTCCAGGGAAAGAGCCAC<br>CCTCTCCTGCAGGGCCAGTC<br>AGAGTGTTAACAGCAGGCA<br>GTTAGCCTGGTACCAGCAGA<br>AACCTGGCCAGGCTCCCAG<br>GCTCCTCCATCTATGGTGCGT<br>CCAGCAGGGCCACTGGCAT<br>CCCAGAGAGGTTCAGTGGC<br>AGTGGATCTGGGACAGACTT<br>CACTCTCACCATCAGCAGAC<br>TGGAGTCTGAAGATTTTGCA<br>GTGTATCACTGTCAGCAATA<br>TGTAGTCAGGGCGTCA<br>CTTTCGCGGAGGGACCAA<br>GGTGGAGATCAAAC (SEQ ID NO: 3509) | COVO72_P2_B12 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | ACAATTCCAAGAACACGCT GTTTCTGCAACTGAACAGC CTGAGAGCCGAGGACGCGG CCGTGTATTCCTGTGCGAAC CACCCTCTGCCATCAGGCG ACGACTACTACCACTACTA CATGGACGTCTGGGCAAA GGGACCACGGTCACCGTCT CCTCAGCGTCGACCAAGGG CCCATCGGTCTTCCCCCTGG CACCCTCCTCCAAGAGCAC CTCTGGGGGCACAGCGGCC CTGGGCTGCCTGGTCAAGG ACTACTTCCCCGAACCTGTG ACGGTCTCGTGGAACTCAG GCGCCCTGACCAGCGGCGT GCACACCTTCCCGGCTGTCC TACAGTCCTCAGGACTCTA CTCCCTCAGCAGCGTGGTG ACCGTGCCCTCCAGCAGCT TGGGCACCCAGACCTACAT CTGCAACGTGAATCACAAG CCCAGCAACACCAAGGTG GACAAGAGAGTTGAGCCCA AATCTTGTGACAAAACTCA CACATGCCCACCGTGCCCA GCACCTGAACTNCTGGGGG GACCCTCAGTCTTCCTCTTC CCCCCAAAACCCNANGACA CCCTCATGATCTNCNNGAC CCNNGAGTCACATGCCGTG GNGNGNGNNGTGANCCACN ANGACCNTGACTTCAGTTCA NTNNNCNTGNNGGCGTGNN NGCANNANGCNANNANNAN ANCNNNNGGAGGANCANT ACNANNNNCNNNNNNCNNN NNNNNNANNCNNNN (SEQ ID NO: 3506) | | | | | |
| V-C029 | | NNNNNNNNNNTTATGTATC NTACACATACGATTTAGGT GACACTATAGGAATAACATC CACTTTGCCCTTTCTCTCCAC AGGTGCCACTCCCAGGTC | CAGGTGCAGCTGGTGGAGT CTGGGGGAGGCGTGGTCCA GCCTGGGAGGTCCCTGAGA CTCTCCTGTGCAGCCTCTGG ATTCACCTTCAGTAGTAGTATG | COV072_P2_C7 | GNNNNNNNNNNNTTATN NNATCNTACACCATACGA TTTAGGTGACACTATAG AATAACATCCACTTTGCC TTTCTCTCCACAGGTGTC | GACATCCAGATGACCCAGTC TCCATCCTCCCTGTCTGCAT CTGTAGGAGACAGAGTCAC CATCACTTGCCAGGCGAGTC AGGACATTAGCAACTATTTA | COV072_P2_C7 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | CAACTGCACCTCGGTTCTAT | GCATGAACTGGGTCCGCCA | | CACTCCCAGGTCCAACT | AATTGGTATCAGCAGAAAC | |
| | | CGATTGAATTCCACCATGG | GGCTCCAGGCAAGGGGCTG | | GCACCTCGGTTCTATCGA | CAGGGAAAGCCCCTAAGCT | |
| | | GATGGTCATGTATCATCCTT | GAGTGGGTGGCAGTTATAT | | TTGAATTCCACCATGGG | CCTGATCTACGATGCATCCA | |
| | | TTTCTAGTAGCAACTGCAA | CATATGATGGAAGTAATAC | | ATGGTCATGTATCATCCT | ATTTGGAAACAGGGGTCCC | |
| | | CCGGTGTACATTCTCAGGT | ATACTATACAGACTCCGTG | | TTTTCTAGTAGCAACTGC | ATCAAGGTTCAGTGGAAGT | |
| | | GCAGCTGGTGGAGTCTGGG | AAGGGCCGATTCACCATCT | | AACCGGTGTACATTCTG | GAATCTGGGACAGATTTTAC | |
| | | GGAGGCGTGGTCCAGCCTG | CCAGAGACAATTCCAAGAA | | ACATCCAGATGACCCAG | TTTCACCATCAGCAGCCTGC | |
| | | GGAGGTCCCTGAGACTCTC | CACGCTGTATCTGCAAATG | | TCTCCATCCTCCCTGTCT | AGCCTGAAGATATTGCAAC | |
| | | CTGTGCAGCCTCTGGATTCA | AACAGCCTGAGAGTTGACG | | GCATCTGTAGGAGACAG | ATATTACTGTCAACAGTATG | |
| | | CCTTCAGTAGCTATGGCAT | ACACGGCTACATATTACTG | | AGTCACCATCACTTGCCA | ATAATCTCCCGATCACCTTC | |
| | | GAACTGGGTCCGCCAGGCT | TGCGAAAGGGCCCCGGTTT | | GGCGAGTCAGGACATTA | GGCCAAGGGACACGACTGG | |
| | | CCAGGCAAGGGGCTGGAGT | GGCTGGAGCTATAGAGGGG | | GCAACTATTTAAATTGGT | AGATTAAAC (SEQ ID | |
| | | GGGTGGCAGTTATATCATA | GGTCTGGTTTTGATATCTGG | | ATCAGCAGAAACCAGGG | NO: 3513) | |
| | | TGATGGAAGTAATACATAC | GGCCAAGGGACAATGGTCA | | AAAGCCCCTAAGCTCCT | | |
| | | TATACAGACTCCGTGAAGG | CCGTCTCTTCAG (SEQ | | GATCTACGATGCATCCA | | |
| | | GCCGATTCACCATCTCCAG | ID NO: 3511) | | ATTTGGAAACAGGGGTC | | |
| | | AGACAATTCCAAGAACACG | | | CCATCAAGGTTCAGTGG | | |
| | | CTGTATCTGCAAATGAACA | | | AAGTGAATCTGGGACAG | | |
| | | GCCTGAGAGTTGACGACAC | | | ATTTTACTTTCACCATCA | | |
| | | GGCTACATATTACTGTGCG | | | GCAGCCTGCAGCCTGAA | | |
| | | AAAGGGCCCCGGTTTGGCT | | | GATATTGCAACATATTAC | | |
| | | GGAGCTATAGAGGGGGGTC | | | TGTCAACAGTATGATAA | | |
| | | TGGTTTTGATATCTGGGGCC | | | TCTCCCGATCACCTTCGG | | |
| | | AAGGGACAATGGTCACCGT | | | CCAAGGGACACGACTGG | | |
| | | CTCTTCAGCGTCGACCAAG | | | AGATTAAACGTACGGTG | | |
| | | GGCCCATCGGTCTTCCCCCT | | | GCTGCACCATCTGTCTTC | | |
| | | GGCACCCTCCTCCAAGAGC | | | ATCTTCCCGCCATCTGAT | | |
| | | ACCTCTGGGGGCACAGCGG | | | GAGCAGTTGAAATCTGG | | |
| | | CCCTGGGCTGCCTGGTCAA | | | AACTGCCTCTGTTGTGTG | | |
| | | GGACTACTTCCCCGAACCT | | | CCTGCTGAATAACTTCTA | | |
| | | GTGACGGTCTCGTGGAACT | | | TCCCAGAGAGGCCAAAG | | |
| | | CAGGCGCCCTGACCAGCGG | | | TACAGTGGAAGGTGGAT | | |
| | | CGTGCACACCTTCCCGGCT | | | AACGCCCTCCAATCGGG | | |
| | | GTCCTACAGTCCTCAGGAC | | | TAACTCCCAGGAGAGTG | | |
| | | TCTACTCCCTCAGCAGCGTG | | | TCACAGAGCAGGACAGC | | |
| | | GTGACCGTGCCCTCCAGCA | | | AAGGACAGCACCTACAG | | |
| | | GCTTGGGCACCCAGACCTA | | | CCTCAGCAGCACCCTGA | | |
| | | CATCTGCAACGTGAATCAC | | | CGCTGAGCAAAGCAGAC | | |
| | | AAGCCCAGCAACACCAAGG | | | TACGAGAAACACAAAGT | | |
| | | TGGACAAGAGAGTTGAGCC | | | CTACGCCTGCGAAGTCA | | |
| | | CAAATCTTGTGACAAAACT | | | CCCATCAGGGCCTGAGC | | |
| | | CACACATGCCCACCGTGCC | | | TCGCCCGTCACAAAGAG | | |
| | | CAGCACCTGAACTCCTGGG | | | CTTCAACAGGGGAGAGT | | |
| | | GGGACCGTCAGTCTTCCTCT | | | GTTAGAAGCTTGGNCGC | | |
| | | TCCCCCCAAAACCCAAGGA | | | CATGGCCCAACTTGTTTA | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CACCCTCATGATCTCCGG ACCCTGAGTCACATGCG TGGNGNNGACGTGAGCCA CGAANANCCTGAGTCAAG TTCAACTGGNACGNNGNNG GCGTNNNNTGCATNANGCC ANACAAAGCNNNGGGAN GNANCAGTACACAGCNNNT ACCGNGNGGNCAGCNNCCN NNNCCGN

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | GGTCA TABLE 15-continued Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| | CAGTGGGTGCGACAGG TABLE 15-continued Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C032 | NNNNNNNNNNNTGTATC ATACACATACGATTAGGT GACACTATAGAATAACATC CACTTTGCCTTTCTCTCCAC NGGTGTCCACTCCCAGGTC CAACTGCACCTCGGTTCTAT CGATTGAATTCCACCATGG GATGTCTAGTAGCAACTGCAA TTTCTAGTACAATTCCCAGT CCGGTGTACATTCCCAGT GCAGCTGCAGGAGTCGGGC CCAGGACTGTGAAGCCTT CGGGGACCCTGTCCCTCAC CTGCCCTGTCTCTGGTGGCT CCATCAGCAGTAATAACTG GTGGAGTTGTCTCCGCCAG CCCCCAGGGAAGGGGCTGG AGTGGATTGGGGAAATCTA TCATAGTGGGAGCACCAAC TACAACCCGTCCCTCAAGA GTCGAGTCACCATATCAGT AGACAAGTCCAAGAACCAG TTCTCCCTGAAGCTGAGCTC TGTGACCGCCGCGGACACG GCCGTGTATTACTGTGCGA GAGGGGGATACAGCTAT GGGCCCGAATACTTTGAC TACTGGGGCCAGGGAACCC TGGTCACCGTCTCCTCAGCG TCGACCAAGGGCCCATCGG TCTTCCCCCTGGCACCCTCC TCCAAGAGCACCTCTGGGG GCACAGCGGCCCTGGGCTG CCTGGTCAAGGACTACTTC CCGAACCTGGTGACGTGT CGTGGAACTCAGGCGCCCT GACCAGCGGCGTGCACACC TTCCCGGCTGTCCTACAGTC CTCAGGACTCTACTCCCTCA GCAGCTGGTGACCGTGCC CTCCAGCAGCTTGGGCACC CAGACCTACATCTGCAACG TGAATCACAAGCCCAGCAA CACCAAGGTGGACAAGAGA | CAGGTGCAGCTGCAGGAGT CGGGCCCAGGACTGTGAA GCCTTCGGGGACCCTGTCC CTCACCTGCGCTGTCTCTGG TGGCTCCATCAGCAGTAAT AACTGGTGGAGTTGTCTCC GCCAGCCCCCAGGGAAGGG GCTGGAGTGGATTGGGGAA ATCTATCATAGTGGGAGCA CCAACTACAACCGGTCCCT CAAGAGTCGAGTCACCATA TCAGTAGACAAGTCCAAGA ACCAGTTCTCCCTGAAGCT GAGCTCTGTGACCGCCGCG GACACGGCCGTGTATTACT GTGCGAGAGGGGGCCCCGAATAC AGTATGGGCCCCGAATAC TTTGACTACTGGGGCCAGG GAACCCTGGTCACCGTCTC CTCAG (SEQ ID NO: 3523) | COV072_P3_C1 | NNNNNNNNNNNNNNN NTNNTNNNNTACNNNTA CNATTTAGGTGACACTAT AGAATAACATCCACTTT GCCTTTCTCTCCNGGT GTCCACTCCCAGGTCCA ACTGCACCTCGGTTCTAT CGATTGAATTCCACCATG GGATGGTCATGTATCATC CTTTTTCTAGTAGCAACT GCAACCGTTCCTGGGC CCAGTCTGCCCTGACTCA GCCTGCCTCCGTGTCTGG GTCTCCTGGACAGTCGAT CACCATCTCCTGCACTGG AACCAGCAGTGACCTTG GTGGTTATAACTATGTCT CCTGGTACCAACAACAC CCAGCAAAGCCCCAA ACTCATGATTTATGATGT GGGTTTCTAATCGCTTCT CTGGCTCCAAGTCTGGC AACACGGCCTCCCTGAC CATCTCTGGGCTCCAGGC TGAGGACGAGGCTGATT ATTACTGCAGCTCATATA CAAGCAGCAGCACTCTT TTGTTCGGCGGAGGGAC CAAGCTGACCGTCCTAG GTCAGCCCAAGGCTGCC CCCTCGGTCACTCTGTTC CCACCCTCGAGTGAGGA GCTTCAAGCCAACAAGG CCACACTGGTGTGTCTCA TAAGTGACTTCTACCCGG GAGCCGTGACAGTGGCC TGNAAGGCAGATANCAG CCCGTCAAGGCGGGAN TGGAGACCACCACACC TCCAAACAAAGCAACAA CAAGTACCTGACCACC AGCTACCTGANCNTGA CGCCCTGAGCANTGGAAG | CAGTCTGTGCTGACTCAGCC TGCCTCCGTGTCTGGGTCTC CTGGACAGTCGATCACCATC TCCTGCACTGGAACCAGCAG TGACGTTGGTGGTTATAACT ATGTCTCCTGGTACCAACAA CACCCAGGCAAAGCCCCCA AACTCATGATTTATGATGTC AGTAATCGGCCCTCAGGGGT TTCTAATCGCTTCTCTGGCT CCAAGTCTGGCAACACGG CCAGGCTGAGGACGAGGC TGATTATTACTGCAGCTCAT ATACAAGCAGCAGCACTCTT TTGTTCGGCGGAGGGACCA AGCTGACCGTCCTAG (SEQ ID NO: 3525) | COV072_P3_C1 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | GTTGAGCCCAAATCTTGTG<br>ACAAAACTCACACATGCCC<br>ACCGTGCCCAGCACCTGAA<br>CTCCTGGGGGACCGTCAG<br>TCTTCCTCTTCCCCCCAAAA<br>NCCNAAGGACACCCTCATG<br>ATCTCCCNGACCCNTGAGG<br>TCNACATGCCTGGTGGNGG<br>NCGTGANCCACNAAGACCC<br>TGNNNGTCAAGTTCAACTG<br>GNTACGTGGNANGGGNGNN<br>NNNGGNNCANN (SEQ ID<br>NO: 3522) | | | TCCCACAGAAGCNTACA<br>GCTGCCANGTCACGCAT<br>GAAGGAGCACCGNGNA<br>GAGANANTGGCNCCTAC<br>AGAATGTTCATANAANC<br>TTGGCCGCCCANGGCCC<br>AACTTGTTATTGNNGCTT<br>ATNN (SEQ ID NO: 3524) | | |
| V-C033 | NNNNNNNNNNNNNGNN<br>TNNTACACATATAGATTTAG<br>GTGACACTATAGAATAACA<br>TCCACTTTGCCTTTCTCC<br>ACNGNTGTCCACTCCCAGG<br>TCCAACTGCACCTCGGTTCT<br>ATCGATTGAATTCCACCAT<br>GGGATGGTCATGTATCATC<br>CTTTTCTAGTAGCAACTGC<br>AACCGTGTACATTCTCAG<br>GTGCAGCTGTGGAGTCTG<br>GGGAGGCGTGGTCAGCC<br>TGGAGGTCCCTGAGACTC<br>TCCTGTGCAGCCTCTGATT<br>CACCTTCAGTAGCTATGCTA<br>TGCACTGGGTCCGCCAGGC<br>TCCAGGCAAGGGGTGGAG<br>TGGGTGGCAGTTATATTAT<br>ATGATGGAAGCAATAAATA<br>CTACGCAGACTCCGTGAAG<br>GGCCGATTCACCATCTCCA<br>GAGACAATTCCAAGAACAC<br>GCTGTATCTGCAAATGAAC<br>AGCCTGAGAGCTGAGGACA<br>CGGCTGTGTATTACTGTGCG<br>AGAGATTCGACGTAGATA<br>CATCTATGGTTACTTGGTTC<br>GACTACTGGGGCCAGGAA<br>CCCTGGTCACCGTCTCCTCA<br>GCGTCGACCAAGGGCCCAT<br>CGGTCTTCCCCCTGCACCC | CAGGTGCAGCTGGTGGAGT<br>CTGGGGGAGGCGTGGTCCA<br>GCCTGGAGGTCCCTGAGA<br>CTCTCCTGTGCAGCCTCTGG<br>ATTCACCTTCAGTAGCTATG<br>CTATGCACTGGGTCCGCCA<br>GGCTCCAGGCAAGGGGCTG<br>GAGTGGGTGGCAGTTATAT<br>TATATGATGGAAGCAATAA<br>ATACTACGCAGACTCCGTG<br>AAGGGCCGATTCACCATCT<br>CCAGAGACAATTCCAAGAA<br>CACGCTGTATCTGCAAATG<br>AACAGCCTGAGAGCTGAGG<br>ACACGGCTGTGTATTACTGT<br>GCGAGAGATTCGACGTAG<br>ATACATCTATGGTTACTTGG<br>TTCGACTACTGGGGCCAGG<br>GAACCCTGGTCACCGTCTC<br>CTCAG (SEQ ID NO: 3527) | COV072_P3_E5 | GNNNNNNNNNNNGTAT<br>CNNNNCNCATACGATTTA<br>GGTGACACTATAGAATA<br>ACATCCACTTTGCCTTTC<br>TCTCCACNGGTGTCCACT<br>CCCAGGTCCAACTGCAC<br>CTCGGTTCTTATCGATTGA<br>ATTCCACCATGGGATGG<br>TCATGTATCATCCTTTTT<br>CTAGTGATGAACTGCAAC<br>CGTGTACATTCTGACAT<br>CCAGATGACCCAGTCTC<br>CATCTCCCCTGTCTGCAT<br>CTGTAGGAGACAGAGTC<br>ACCATCACTTGCCGGGC<br>AAGTCAGAGCATTAGCA<br>GCTATTTAAATTGGTATC<br>AGCAGAAACCAGGGAAA<br>GCCCCTAAGCTCCTGATC<br>TATGCTGCATCCAGTTTG<br>CAAAGTGGGTCCCATC<br>AAGGTTCAGTGGCAGTG<br>GATCTGGGACAGATTTC<br>ACTCTCACCATCAGCAGT<br>CTGCAACCTGAAGATTTT<br>GCAACTTACTACTGTCAA<br>CAGAGTTACAGTACCC<br>TCCGTGACGTTCGGCC<br>AAGGGACCAAGGTGAA<br>ATCAAACGTACGGTGGC<br>TGCACCATCTGTCTTCAT | GACATCCAGATGACCCAGTC<br>TCCATCTCCCCTGTCTGCAT<br>CTGTAGGAGACAGAGTCAC<br>CATCACTTGCCGGGCAAGTC<br>AGAGCATTAGCAGCTATTTA<br>AATTGGTATCAGCAGAAAC<br>CAGGGAAAGCCCCTAAGCT<br>CCTGATCTATGCTGCATCCA<br>GTTTGCAAAGTGGGGTCCCA<br>TCAAGGTTCAGTGGCAGTGG<br>ATCTGGGACAGATTTCACTC<br>TCACCATCAGCAGTCTGCAA<br>CCTGAAGATTTTGCAACTTA<br>CTACTGTCAACAGAGTTACA<br>GTACCCCTCCGTGACGTTC<br>GGCCAAGGGACCAAGGTGG<br>AAATCAAAC (SEQ ID NO: 3529) | COV072_P3_E5 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TCCTCCAAAGAGCACCTCTG<br>GGGGCACAGCGGCCCTGGG<br>CTGCCTGGTCAAGGACTAC<br>TTCCCCGAACCTGTGACGG<br>TCTCGTGGAACTCAGGCGC<br>CCTGACCAGCGGCGTGCAC<br>ACCTTCCCGGCTGTCCTACA<br>GTCCTCAGGACTCTACTCCC<br>TCAGCAGCGTGGTGACCGT<br>GCCCTCCAGCAGCTTGGGC<br>ACCCAGACCTACATCTGCA<br>ACGTGAATCACAAGCCCAG<br>CAACACCAAGGTGGACAA<br>GAGAGTTGANCCCAAATCT<br>TGTGACAAAACTCACACAT<br>GCCCACCGTGCCCAGCACC<br>TGAACTCCTGGGGGACCG<br>TCAGTCTTCCTCTTCCCCCN<br>NAAACCANNGGANACCCNC<br>ATGATCTCCNGACCCCCTG<br>AGNCACNTGNNNTGGNNGN<br>GGANNNGANCCNCGAAG<br>CTGGNNCNNNGGAANGNN<br>NNNNN (SEQ ID NO: 3526) | | | | | |
| V-C034 | NNNNNNNCNNNTGTATC<br>NTACACATAGCATTTAGGT<br>GACACTATAGAATAACATC<br>CACTTTGCCTTTCTCCCAC<br>AGGTCTCCACTCCCAGGTC<br>CAACTGCACCTCGGTTCTAT<br>CGATTGAATTCCACCATGG<br>GATGGTCATGTATCATCCTT<br>TTTCTAGTAGCAACTGCAA<br>CCGGTGTACATTCTGAGGT<br>GCAGCTGTTGGAGTCTGGG<br>GGAGGCTCCGTACAGCCTG<br>GGGGTCCCTGAGACTCTC<br>CTGTGCAGCCTCTGATTCA<br>CCTTTAGCAACTATGCCATG<br>AGCTGGGTCCGCCAGGCTC<br>CAGGAAGGGCTGGAGTG<br>GGTCTCAGCTATTAGTGGT | GAGGTGCAGCTGTTGGAGT<br>CTGGGGGAGGCTTGGTACA<br>GCCTGGGGGGTCCCTGAGA<br>CTCTCCTGTGCAGCCTCTGG<br>ATTCACCTTTAGCAACTATG<br>CCATGAGCTGGGTCCGCCA<br>GGCTCCAGGGAAGGGCTG<br>GAGTGGGTCTCAGCTATTA<br>GTGGTAGTGATGGTAGCAC<br>ATACTACGCAGGCTCCGTG<br>AAGGGCCGGTTCACCATCT<br>CCAGAGACAATTCCAAGAA<br>CACACTGTATCTGCAAATG<br>AACAGCCTGAGAGCCGAGG<br>ACACGGCCGTATATTACTG<br>TGCGAAAGATCCCCCTATA<br>ACTGGACCTACCTATCAAT<br>ACTTTCACTACTGGGGCCA | COV072_<br>P3_H9 | NNNNNNNNNNNTGTAT<br>CATACACATACGATTTA<br>GGTGACACTATAGAATA<br>ACATCCACTTTGCCTTTC<br>TCTCCACAGGTGTCCACT<br>CCCAGGTCCAACTGCAC<br>CTCGGTTCTATCGATTGA<br>ATTCCACCATGGGATGG<br>TCATGTATCATCCTTTTT<br>CTAGTAGCAACTGCAAC<br>CGGTTCTGTGACTCTCCTA<br>TGAGCTGACACAGCCCC<br>CCTCAGTCTCAGTGCCC<br>CAGGAAAGACGGGCCAGG<br>ATTACCTGTGGGGAAA<br>CAACATTGGAAGTAAAA<br>GTGTGCACTGGTACCAG<br>CAGAAGCCAGGCCAGGC | TCCTATGTGCTGACTCAGCC<br>ACCCTCAGTGTCAGTGCCCC<br>CAGGAAAGACGGCCAGGAT<br>TACCTGTGGGGAAACAAC<br>ATTGGAAGTAAAAGTGTGC<br>ACTGGTACCAGCAGAAGCC<br>AGGCCAGGCCCCTGTGCTGG<br>TCATCTATTATGATAGCGAC<br>CGGCCCTCAGGGATCCTGA<br>GCGATTCTCTGGCTCCAACT<br>CTGGGAACACGGCAGGGTCA<br>GCCATCAGCAGGGCCGAAT<br>GCCGGGATGAGGCCGGAT<br>ATCACTGTCAGGTGTGGGAT<br>AGTAGTAGTGATCGTCCGGG<br>GGTGGTTTTCGCGCGAGGG<br>ACCAAGCTGACCGTCCTAG<br>(SEQ ID NO: 3533) | COV072_<br>P3_H9 |

TABLE 15-continued

Additional sequence information for the disclosed anti-SARS-CoV-2 antibodies

| | | HEAVY CHAIN | | LIGHT CHAIN | |
|---|---|---|---|---|---|
| ALICE | AbsID | miniprep sequence | original nt sequence | sequence ID (plate/well) | miniprep sequence | original nt sequence | sequence ID (plate/well) |
| | | AGTGATGGTAGCACATACT ACGCAGGCTCCGTGAAGGG CCGGTTCACCATCTCCAGA GACAATTCCAAGAACACAC TGTATCTGCAAATGAACAG CCTGAGAGCCGAGGACACG GCCGTATATTACTGTGCGA AAGATCCCCTTATAACTGG ACCTACTTATCAATACTTTC ACTACTGGGGCCAGGGAAC CCTGGTCACCGTCTCCTCAG CGTCGACCAAGGGCCCATC GGTCTTCCCCCTGGCACCCT CCTCCAAGAGCACCTCTGG GGGCACAGCGGCCCTGGGC TGCCTGGTCAAGGACTACT TCCCCGAACCTGTGACGGT CTCGTGGAACTCAGGCGCC CTGACCAGCGGCGTGCACA CCTTCCCGGCTGTCCTACAG TCCTCNNACTCTACTCCCTC AGCAGCGTGGTGACCGTGC CCTCCAGCAGCTTGGGCAC CCAGACCTACATCTGCAAC GTGAATCACAAGCCCAGCA ACACCNAAGGTGGACCAAGA NAGTTGAGCCCAAATCTTG TGACAAAACTCACACATGC CCACCGTGCCCAGCACCTG AACTNCTGGGGGGACCGT CAGTCTTCCTTCTTCCCCCNA AANCCNAGGANACCCTCAT GATCTCNNACCCCNGAA GGTCNCATGCNTGGNNGGT GACGTGAGCNCGAANNA NCCNN (SEQ ID NO: 3530) | GGGAACCCTGGTCACCGTC TCCTCAG (SEQ ID NO: 3531) | | CCCTGTGCTGGTCATCTA TTATGATAGCGACCGGC CCTCAGGGATCCCTGAG CGATTCTCTGGCTCCAAC TCTGGAACACGGCCAC CCTGACCATCAGCAGGG TCGAAGCCGGGGATGAG GCCGAATATCACTGTCA GGTGTGGGATAGTAGTA GTGATCGTCCGGGGGTG GTTTTCGGCGGAGGGAC CAAGCTGACCGTCCTAG GTCAGCCCAAGGCTGCC CCCTCGGTCACTCTGTTC CCACCCTCGAGTGAGGA GCTTCAAGCCAACAAGG CCACACTGGTGTCTCA TAAGTGACTTCTACCCGG GAGCCGTGACAGTGGCC TGGAAGGCAGATAGCAG CCCCGTCAAGGCGGAG TGGAGACCACCAACCC TCCAAACAAAGCAACAA CAAGTACGGCCCAGCA GCTACCTGAGCCTGACG CCTGAGCAGTGGAAGTC CCAGAAGCTACAGCT GCCAGGTCACGCATGAA GGGAGCACCCGTGAGAA GACAGTGGCCCTACAG AATGTTCATAGAAGCTT GGCCCCATGGNCCAAC TTGTTTATTGCAGCTTAN NATGGTTACAAATAAAG CAATAGCATCACAAATT TCACAAANAAAGCATTT TTTTCACTGCATCTANTG TGGNTNNTCCNAACNCA TCNATGNNNNTNNCAT GTCTGGATCN (SEQ ID NO: 3532) | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C035 | NNNNNNNNNNTGTATCNT ACACATACGATTTAGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTAGACAATTCTCAGGTGC AGCTGGTGGAGTCTGGGGG AGGCGTGGTCCAGCCTGGG AGGTCCCTGAGACTCTCCT GTGCAGCCTCTGGATTCAC CTTCAGTAGCTATGCTATGC ACTGGGTCCGCCAGGCTCC AGGCAAGGGGCTGGAGTGG GTGGCAGTTATACCATTTG ATGGAAGAAATAAGTACTA CGCAGAGACTCCGTGACGGC CGATTCACCATCTCCAGAG ACAATTCCAAGAACACACT GTATCTGCAAATGAACAGC CTGAGAGCTGAGGACACGG CTGTGTATTACTGTGCGAGT AGTAGTGGTTATCTTTTCCA CTCTGACTACTACTGGGCCAG GGAACCCTGGTCACCGTCT CCTCAGCGTCGACCAAGGG CCCATCGGTCTTCCCCCTGG CACCCTCCTCCAAGAGCAC CTCTGGGGGCACAGCGGCC CTGGGCTGCCTGGTCAAGG ACTACTTCCCCGAACCTGTG ACGGTCTGTGGAACTCAG GCGCCCTGACCAGCGGCGT GCACACCTTCCCGGCTGTCC TCACAGTCCTCANGACTCTA CTCCCTCAGCAGCGTGGTG ACCGTGCCCTCCAGCAGCT TGGGCACCCAGACCTACAT CTGCAACGTGAATCACAAG CCCAGCAACACCNAAGGTG GACAAGANAGTTGAGCCCA | CAGTGCAGCTGGTGGAGT CTGGGGGAGGCGTGGTCCA GCCTGGGAGGTCCCTGAGA CTCTCCTGTGCAGCCTCTGG ATTCACCTTCAGTAGCTATG CTATGCACTGGGTCCGCCA GGCTCCAGGCAAGGGGCTG GAGTGGGTGGCAGTTATAC CATTTGATGGAAGAAATAA GTACTACGCAGAGACTCCGTG AGTCTGTAGCAACTCCGTG ACGGGCCGATTCACCATCT CCAGAGACAATTCCAAGAA CACACTGTATCTGCAAATG AACAGCCTGAGAGCTGAGG ACACGGCTGTGTATTACTGT GCGAGTAGTAGTGGTTATC TTTTCCACTCTGACTACTGG GGCCAGGGAACCCTGGTCA CCGTCTCCTCAG (SEQ ID NO: 3535) | COV072_ P3_D9 | NNNNNNNNNNTNTGT ATCNTACNTACNTACGATTT AGTGACACTATAGAAT AACATCCACTTTGCCTTT CTCTCCACAGGTGTCCAC TCCCAGGTCCAACTGCA CCTCGGTTCTATCGATTG AATTCCACCATGGGATG GTCATGTATCATCCTTTT TCTAGTAGCAACTGCACA CCGGTGTACATTCTGACA TCCAGATGACCCAGTCTC CTTCCACCCTGTCTGCAT CTGTAGGAGACAGAGTC ACCATCACTTGCCGGC CAGTCAGAGTATTAGTA ACTGGTTGGCCTGGTTTC AGCAGAAACCAGGGAAA GCCCCTAAGCTCCTGATC TATGAGGCGTCTAGTTTA GAAAGTGGGGTCCCATC AAGGTTCAGCGGCAGTG GATCTGGGACAGAATTC ACTCTCACCATCAGCAG CCTGCAGCCTGATGATTT TGCAACTTATTACTGCCA ACAGTATAATAGTTATCC GTGGACGTTCGGCCAAG GGACCAAGGTGGAGATC AAACCTACGGTGGCTGC ACCATCTGTCTTCATCTT CCCGCCATCTGATGAGC AGTTGAAATCTGAACT GCCTCTGTTGTGTGCCTG CTGAATAACTTCTATCCC AGAGAGGCCAAAGTACA GTGGAAGGTGGATAACG CCCTCCAATCGGGTAACT CCCAGGAGAGTGTCACA GAGCAGGACAGCAAGGA CAGCACCTACAGCCTCA GCAGCACCCTGACGCTG AGCAAAGCAGACTACGA GAAACACAAAGTCTACG | COV072_ P3_D9 |
| | | | | | CAAGGACCAAGGTGGAAA TCAAAC (SEQ ID NO: 3537) | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AATCTTGTGACAAACTCA CACATGCCCACCGTGCCA GCACCTGAACTCCTGGGG GACCCTCAGTCTTCCTCTTC CCCCAAAACCCANNNNAC CCNCATGATCTCCCNNACC CCTGANNCNCATGNNNGGN GGNNNCGTGAGCCACNAAG ACCNTGNNNCAGTTCAACT GGNACNNNGNNGNNNNGG NNGTGCATAATGNCAANAA NNAAGCCNCGGANNANC ANTANNANNGCNNCGTACC GNNNNNNGNNNNNNGTN NNNNNCGNCCNGCACNNNN GNAANNNNNNNNTNN (SEQ ID NO: 3534) | | | CCTGCGAAGTCACCCAT CNGGGCCTGAGCTCGCC CGTCACAAAGAGCTTCA ACAGGGGAGAGTGTTAG AAGCTTGGCGCGCCATGG CCCAACTTGTTTATTGCA GCTATAAATGGNTACAA ATAAAGCAATAGCATCA CAATTTCACAAATAAAG CATTTTTTCACTGCATT CTAGTTGTGGTTTGTCCA ANTCCATNANGNATNNN NCATGTCTNGNTCGGGN NNNTCGNNGCAGCACCA NGGNCNNGAANNNACCN CNNANNAN (SEQ ID NO: 3536) | | |
| V-C036 | NNNNNNNNATGNATCNT ACANTACGATTAGGTGA CACTATAGAATAACATCCA CTTTGCCTTTCTCTCCACAG GTGTCCACTCCCAGTCCA ACTGCACCTGGGTTTATCG ATTGAATTCCACCATGGAA TGGTCATGTATCATCCTTTT TCTAGTAGCAACTGCAACC GGTGTACATTCGAGTGC AGCTGGTGCAGTCTGAGT AGAGTGGAAAAGTCGGGG GAGTCTCTGAAGATCTCCT GTAAGGGCTCTGGATACAA CTTTGCCACCTCCGCTCG GCTGGGTGCGCCAGATGCC CGGCAAAGGGCCTGGAGTGG ATGGGATCATCTATCCTG GTGACTCTGATACCAGATA CAGCCCGTCCTTCCAAGGC CAGGTCACCATCTCAGCCG ACAAGTCCACGAGCACCGC CTACCTGCAGTGGAGCAGC CTGAAGGCCTCGGACACCG CCATGTATTACTGTGCGAG ACTCACATATACCAGTGGC TGGTACTGGGGCCAGGGAA | GAGGTGCAGCTGGTGCAGT CTGGAGTAGAGGTGAAAAA GTCGGGGGAGTCTCTGAAG ATCTCCTGTAAGGGCTCTG GATACAACTTTGCCACCTCC TGGCTCGGCGGGTGCGCC AGATGCCCGGCAAAGGCCT GGAGTGGATGGGATCATC TATCCTGGTGACTCTGATAC CAGATACAGCCCGTCCTTC CAAGGCCAGGTCACCATCT CAGCCGACAAGTCCATGAG CCACCGCCTACCTGCAGTGG AGCAGCCTGAAGGCCTCGG ACACCGCCATGTATTACTGT GCGAGACTCACATATACCAG TGGCTGGTACTGGGGCCA GGGAACCCCTGGTCACCGTC TCGTCAG (SEQ ID NO: 3539) | COV072_ P2_B10 | NNNNNNNNTATGTATC NTACNATACGATTAG GTGACACTATAGAATAA CATCCACTTTGCCTTTCT CTCCACAGGTGTCCACTC CCAGTCCAACTGCACC TCGGTTCTATCGATTGAA TTCCACCATGGGATGGTC ATGTATCATCCTTTTTCT AGTAGCAACTGCAACCG GTTCCTGGGCCCAGTCTG CCCTGACTCAGCCTCCCT CCGTGTCCGGGTCTCCTG GACAGTCAGCCATCACC TCCTGCACTGGAACCAG CAGTGAGTTGGTAGTT ATAACCGTGTCTCTTGGT ACCAGCAGCCCCCAGGC ACAGCCCCCAAACTCAT GATTTATGAGGTCAATA ATCGGCCCTCAGGGGTC CCTGATCGCTTCTCTGGG TCCAAGTCTGCAACAC GGCCTCCCTGACCATCTC TGGGCTCCAGGCTGAAG ACGAGGCTGATTATTACT GCAGTCTCATATACAAGC | CAGTCTGTGCTGACTCAGCC TCCCTCCGTGTCCGGGTCTC CTGGACAGTCAGTCACCATC TCCTGCACTGGAACCAGCAG TGACGTTGGTAGTTATAACC GTGTCTCTTGGTACCAGCAG CCCCCAGGCACAGCCCCCA AACTCATGATTTATGAGGTC AATAATCGGCCCTCAGGGGT CCCTGATCGCTTCTCTGGGT CCAAGTCTGGCAACACCGC CTCCCTGACCATCTCTGGGC TCCAGGCTGAAGACGAGGC TGATTATTACTGCAGTCTCAT ATACAAGAGCAGTAGCAATTTC GATGTCTTCGGAACTGGGAC CAAGGTCACCGTCCTAG (SEQ ID NO: 3541) | COV072_ P2_B10 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCCTGGTCACCGTCTCCTCA GCGTCGACCAAGGGCCCAT CGGTCTTCCCCCTGGCACCC TCCTCCAAGAGCACCTCTG GGGGCACAGCGGCCCTGGG CTGCCTGGTCAAGGACTAC TTCCCCGAACCTGTGACGG TCTCGTGGAACTCAGGCGC CCTGACCAGCGGCGTGCAC ACCTTCCCGGCTGTCCTACA GTCCTCNNACTCTACTCCCT CAGCAGCGTGGTGACCGTG CCCTCCAGCAGCTTGGGCA CCCAGACCTACATCTGCAA CGTGAATCACAAGCCCAGC AACACCNANGTGGACAAGA NAGTTGAGCCCAAATCTTG TGACAAAACTCACACATGC CCACCGTGCCCAGCACCTG AACTCCTGGGGGGACCGTC AGTCTTCCNCTTCCCCCCAA ANCNNNNNCACCCTCATGA TCTCCCNGACCCCTGAGTC ACATGCGTGNGNNNNGTGA NCCACGANACCCTGNNNCA GTCANTNNNCGTGNNGGCG TGNNNGCNTANNCNNAANN AGCNCNGGANNNNNANTAC NANNNNNNGTACNNNNG NNAGCGTCNNCNNNNNTCN NNNCNNNNTNNNGAANNN ANGGANNNCAANNNGCAN GGNNNN (SEQ ID NO: 3538) | | | AGTAGCAATTTCGATGTC TTCGAACTGGACCAA GGTCACCGTCCTAGTC AGCCCAAGGCCAACCCC ACTGTCACTCTGTTCCCG CCCTCGAGTGAGGAGCT TCAAGCCAACAAGGCCA CACTGGTGTCTCTCATAA GTGACTTCTACCGGGA GCCGTGACAGTGGCCTG GAAGGCAGATAGCAGCC CCGTCAAGGCGGGACTG GAGACCACCACACCCTC CAAACAAAGCAACAACA AGTACGCGGCCAGCAGC TACCTGAGCCTGACGCCT GAGCAGTGGAAGTCCCA AGGTCACGCATGANGGN NCACCGTGGANAANACA GTGNCCCTACAGAATG TTCATAGAAGCTTGCC GCCATGGCCCAACTTGTT TATTGCAGCTTANNATG G TABLE 15-continued Additional sequence information for the disclosed anti-SARS-CoV-2 antibodies

| ALICE | AbsID | HEAVY CHAIN miniprep sequence | HEAVY CHAIN original nt sequence | HEAVY CHAIN sequence ID (plate/well) | LIGHT CHAIN miniprep sequence | LIGHT CHAIN original nt sequence | LIGHT CHAIN sequence ID (plate/well) |
|---|---|---|---|---|---|---|---|
| | | ATGGTCATGTATCATCCTTT | GGAGTGGATGGGGATCATC | | TTCCACCATGGGATGGTC | AACTCATGATTTATGAGGTC | |
| | | TTCTAGTAGCAACTGCAAC | TATCCTGGTGACTCTGATAC | | ATGTATCATCCTTTTTCT | AATAATCGGCCCTCAGGGGT | |
| | | CGGTGTACATTCCGAGGTG | CAGATACAGCCCGTCCTTC | | AGTAGCAACTGCAACCG | CCCTGATCGCTTCTCTGGGT | |
| | | CAGCTGGTGCAGTCTGGAG | CAAGGCCAGGTCACCATTT | | GTTCCTGGGCCCAGTCTG | CCAAGTCTGGCAACACGGC | |
| | | TAGAGGTGAAAAAGTCGGG | CAGCCGACAAGTCCATCAG | | CCCTGACTCAGCCTCCCT | CTCCCTGACCATCTCTGGGC | |
| | | GGAGTCTCTGAAGATCTCC | CACCGCCTACCTGCAGTGG | | CCGTGTCCGGGTCTCCTG | TCCAGGCTGAAGACGAGGC | |
| | | TGTAAGGGCTCTGGATACA | AGCAGCCTGAAGGCCTCGG | | GACAGTCAGTCACCATC | TGATTATTACTGCAGCTCAT | |
| | | ACTTTGCCACCTCCTGGCTC | ACACCGCCATGTATTACTGT | | TCCTGCACTGGAACCAG | ATACAAGCAGTAGCAATTTC | |
| | | GGCTGGGTGCGCCAGATGC | GCGAGACTCATATATACCA | | CAGTGACGTTGGTAGTT | GATGTCTTCGGAACTGGGAC | |
| | | CCGGCAAAGGCCTGGAGTG | GTGGCTGGTACTGGGGCCA | | ATAACCGTGTCTCTTGGT | CAAGGTCACCGTCCTAG | |
| | | GATGGGGATCATCTATCCT | GGGAACCCTGGTCACCGTC | | ACCAGCAGCCCCCAGGC | (SEQ ID NO: 3545) | |
| | | GGTGACTCTGATACCAGAT | TCCTCAG (SEQ ID | | ACAGCCCCCAAACTCAT | | |
| | | ACAGCCCGTCCTTCCAAGG | NO: 3543) | | GATTTATGAGGTCAATA | | |
| | | CCAGGTCACCATTTCAGCC | | | ATCGGCCCTCAGGGGTC | | |
| | | GACAAGTCCATCAGCACCG | | | CCTGATCGCTTCTCTGGG | | |
| | | CCTACCTGCAGTGGAGCAG | | | TCCAAGTCTGGCAACAC | | |
| | | CCTGAAGGCCTCGGACACC | | | GGCCTCCCTGACCATCTC | | |
| | | GCCATGTATTACTGTGCGA | | | TGGGCTCCAGGCTGAAG | | |
| | | GACTCATATATACCAGTGG | | | ACGAGGCTGATTATTACT | | |
| | | CTGGTACTGGGGCCAGGGA | | | GCAGCTCATATACAAGC | | |
| | | ACCCTGGTCACCGTCTCCTC | | | AGTAGCAATTTCGATGTC | | |
| | | AGCGTCGACCAAGGGCCCA | | | TTCGGAACTGGGACCAA | | |
| | | TCGGTCTTCCCCCTGGCACC | | | GGTCACCGTCCTAGGTC | | |
| | | CTCCTCCAAGAGCACCTCT | | | AGCCCAAGGCCAACCCC | | |
| | | GGGGGCACAGCGGCCCTGG | | | ACTGTCACTCTGTTCCCG | | |
| | | GCTGCCTGGTCAAGGACTA | | | CCCTCGAGTGAGGAGCT | | |
| | | CTTCCCCGAACCTGTGACG | | | TCAAGCCAACAAGGCCA | | |
| | | GTCTCGTGGAACTCANGCG | | | CACTGGTGTGTCTCATAA | | |
| | | CCCTGACCAGCGGCGTGCA | | | GTGACTTCTACCCGGGA | | |
| | | CACCTTCCCGGCTGTCCTAC | | | GCCGTGACAGTGGCCTG | | |
| | | AGTCCTCAGGACTCTACTCC | | | GAAGGCAGATAGCAGCC | | |
| | | CTCAGCAGCGTGGTGACCG | | | CCGTCAAGGCGGGAGTG | | |
| | | TGCCCTCCAGCAGCTTGGG | | | GAGACCACCACACCCTC | | |
| | | CACCCAGACCTACATCTGC | | | CAAACAAAGCAACAACA | | |
| | | AACGTGAATCACAAGCCCA | | | AGTACGCGGCCAGCAGC | | |
| | | GCAACACCAAAGGTGGANA | | | TACCTGAGCCTGACGCCT | | |
| | | AGANAGTTGAGCCCAAATC | | | GAGCAGTGGAAGTCCCA | | |
| | | TTGTGACAAAACTCACACA | | | CAGAAGCTACAGCTGCC | | |
| | | TGCCCACCGNGCCCAGCAC | | | AGGTCACGCATGAAGGG | | |
| | | CTGAACTNCTGGGGGGACC | | | AGCACCGTGGAGAAGAC | | |
| | | GTCAGTCTTCCTCTTCCCCC | | | AGTGGCCCCTACAGAAT | | |
| | | CAAAACCCNNNCACCCTCA | | | GTTCATAGAAGCTTGGN | | |
| | | TGATCTCCCNGACCCCNGA | | | CGCCATGGCCCAACTTGT | | |
| | | GTCACATGCGTGNGNGNCG | | | TTATTGCAGCTTATAATG | | |
| | | TGANCCACGANANCCTGAG | | | GNTACAAATAAAGCAAT | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TCAGTNACTNNNCNNNNNG GNNNGGANNNGCATANNC NNAANNAGCNNNGNAGAG CANTANANAGCNNNNTNCGN GNNNGNCANCGTCNNNNNN CNNN (SEQ ID NO: 3542) | | | AGCATCACAAATTTCAC AAATAAAGCATTTTTTC ACTGCATTCTANTTGTGG TTTNTCCNAACTCATCAN GTATCTNNCATGTCTGGA TCGGGAATTANNCGNCG CAGCNNNTGCCTGAAA NNACNCTGAAAGAGANN NNNNGNNCTNCTGAGNG AAANANNTCNGNNGAAN GNNNGNTCANTNNGGN NNNNGNANGTCCAGNNN CCCNNCAGNNNNNANNN TGNNNGCATNCANNNNN NNNNCNGCNNNNNGNNN NNGGNNNNN (SEQ ID NO: 3544) | | |
| V-C038 | NNNNNNNNATGTATCN TACACATACGATTAGGTG ACACTATAGAATAACATCC ACTTTGCCTTTCTCTCCACA GGTGTCCACTCCCAGGTCC AACTGCACCTGGTTCTATC GATTGAATTCCACCATGGG ATGGTCATGTATCATCCTTT TTCTAGTAGCAACTGCAAC CGGTGTACATTCTGAGGTG CAGCTGGTGGAGTCTGGGG GAGGCTTGGTCCAGCCTGG GGGGTCCCTGAGACTCTCC TGTGCAGCCTCTGGATTCAC ACAGCCTGAGAGCCGACGA CTTTAGTACCTATTGGATGA GCTGGGTCCGCCAGCCTCC AGGGAAGGGGCTGGAGTGG GTGGCCAACATAAAGCAAG ATGGAAGTGAGAAATACTA TGTGGATTCTGTGAAGGGC CGATTCACCATCTCCAGAG ACAACGCCAAGAACTCACT GTATCTGCAAATGAACAGC CTGAGAGCCGACGACACGG CCGTGTATTACTGTGCCGG GGGACATGGCTACGATCC TCTTTTGACTACTGGGCCA | GAGGTGCAGCTGGTGGAGT CTGGGGGAGGCTTGGTCCA GCCTGGGGGGTCCCTGAGA CTCTCCTGTGCAGCCTCTGG ATTCACCTTTAGTACCTATT GGATGAGCTGGGTCCGCCA GCCTCCAGGGAAGGGGCTG GAGTGGGTGGCCAACATAA AGCAAGATGGAAGTGAGAA ATACTATGTGGATTCTGTGA AGGGCCGATTCACCATCTC CAGAGACAACGCCAAGAAC TCACTGTATCTGCAAATGA ACAGCCTGAGAGCCGACGA CACGGCCGTGTATTACTGT GCCGGGGGACATGGCTAC GATCCTCTTTTGACTACTGG GGCCAGGGAACCCTGGTCA CCGTCTCCTCAG (SEQ ID NO: 3547) | COV072_ P2_C9 | NNNNNNNNNNNNTGTA TCNTACACATACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTTCTTGGGCCAATTT TATGCTGACTCAGCCCCA CTCTGTGTCGGAGTCTCC GGGGAAGACTGAAGGA TCTCCTGCACCGGCAGC AGTGGCAGCATTGCCAG CAACTATGTGCAGTGGT ACCAGCAGCGCCCGGGC AGTGCCCCACCACTGT GATCTATGAGGATAACC AAAGACCCTCTGGGGTC CCTGATCCGTTCTCTGGC TCCATCGCAGCTCCTCC AACTCTGCCTCCCTCACC ATCTCTGGACTGAAGAC TGAGGACGAGGCTGACT ACTACTGTCAGTCTTATG | AATTTATGCTGACTCAGCC CCACTCTGTGTCGGAGTCTC CGGGGAAGACTGAAGGTAACCAT CTCCTGCACCGGCCAGCAGTG CAGCATTGCCAGCAACTAT GTGCAGTGGTACCAGCAGC GCCCGGGCAGTGCCCCCACC ACTGTGATCTATGAGGATAA CCAAAGACCCTCTGGGGTCC CTGATCCGTTCTCTGGCTCC ATCGACAGCTCCTCCAACTCTG TGCCTCCCTCACCATCTCTG GACTGAAGACTGAGGACGA GGCTGACTACTACTGTCAGT CTTATGATAGACAGCAATTGG GTGTTCGGCGGAGGGACCA AGCTGACCGTCCTA (SEQ ID NO: 3549) | COV072_ P2_C9 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | GGGAACCCTGGTCACCGTCTCCTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCTGTGACGGTCTCGTGGAACTCAGGCGCCCTGACCAGCGGCGTGCACACCTTCCCGGCTGTCCTACAGTCCTCANGACTCTACTCCCTCAGCAGCGTGGTGACCGTGCCCTCCAGCAGCTTGGGCACCCAGACCTACATCTGCAACGTGAATCACAAGCCCAGCAACACCNAAGGTGGACNAGAGAGTTGAGCCCAAATCTTGTGACNAAACTCACACATGCCCACCGTGCCCAGCACCTGAACTCCTGGGGGGACCGTCAGTCTTCCTCNTCCCCCAAACCCAAGGACACCCTCATGATCTCCCGGACCCTGANTCACATGCNTGGTGGTGGANGTGAGCCACNANNNCNTGAGGTCANTCANTGGNACGNNGNNGGCNNNGAGGTGCATAANNCNNNNNNAAGCNNNGGNAGGANCNNTACAANNNNCNCGTACNNNNNNNNANNNGTCNTNNNCGTNNNNNNNCNNNAANNNNNNNTGAANNG (SEQ ID NO: 3546) | | | ATAGCAGCAATTGGGTGTTCGGCGGAGGGACCAAGCTGACCGTCCTACGTCAGCCCAAGGCTGCCCCCTCGGTCACTCTGTTCCCGCCCTCGAGTGAGGAGCTTCAAGCCAACAAGGCCACACTGGTGTGTCTCATAAGTGACTTCTACCCGGGAGCCGTGACAGTGGCCTGGAAGGCAGATAGCAGCCCCGTCAAGGCGGGAGTGGAGACCACCACACCCTCCAAACAAAGCAACAACAAGTACGCGGCCAGCAGCTACCTGAGCCTGACGCCTGAGCAGTGGAAGTCCCACAGAAGCTACAGCTGCCAGGTCACGCATGAAGGGAGCACCGTGGANAAGACAGTGGCCCCTACAGAATGTTCATAGAAGCTTGGCCGCCATGGCCCAACTTGTTTATTGCAGCTTATAATGGTTACNAATAAAGCAATANCATCACAAATTTCACAAATAAAGCATTTTTTTCACTGCATTCTANTNGNGGTTTGTCCAANCTCATCANGNATNNNNNATGTCTGGATCGGNATTNNNGNNNNNNNCNNCNTGGCCTGAAANNACCTCTGAAAGANNNTNNNNGNANNNNGAGNNNANNNNTCNGNNNNGNNNNGTCANTNGGGTGNNGAANNNCCAGNTNCCCNNCAGNNNANNNNTGNAAGCATGNATNTCNNNNNCANNNNNNNNNGNGNN (SEQ ID NO: 3548) | | |

TABLE 15-continued

Additional sequence information for the disclosed anti-SARS-CoV-2 antibodies

| ALICE | AbsID | HEAVY CHAIN | | | LIGHT CHAIN | |
|---|---|---|---|---|---|---|
| | | miniprep sequence | original nt sequence | sequence ID (plate/well) | miniprep sequence | original nt sequence | sequence ID (plate/well) |
| | V-C039 | NNNNNNNNATGNATCNT ACACATACGATTTAGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACAACTTCAGGTGC AGCTGGTGGAGTCTGGGGG AGGCGTGGTCCAGCCTGGG AGGTCCCTGAGACTCTCCT GTGCAGCCTCTGGATTCAC CTTCAGTAGCTATGCCATGC ACTGGGTCCGCCAGGCTCC AGGGCAAGGGGCTGGAGTGG GTGGCAGTTATATCATATG ATGGAAGTAATAAATACTC TGCAGACTCCGTGAAGGGC CGATTCACCATCTCCAGAG ACAATTCCAAGAACACGCT GTATCTGCAAATGAACAGC CTGAGAGCTGAGGACACGG CTGTGTATTACTGTGCGAA AGGGGGGGCTACAGCTAC TACTACTACGGTATGGACGTCT GGGGCAAAGGGACCACGGT CACCGTCTCCTCAGCGTCG ACCAAGGGCCCATCCGTCT TCCCCCTGGCACCCTCCTCC AAGAGCACCTCTGGGGGCA CAGCGGCCCTGGGCTGCCT GGTCAAGGACTACTTCCCC GAACCTGGACGTCTCGT GGAACTCANGCGCCCTGAC CAGCGGCGTGCACACCTTC CCGGCTGTCCTACAGTCCTC NNNCTCTACTCCCTCAGCA GCGTGGTGACCGTGCCCTC CAGCAGCTTGGGCACCCAG ACCTACATCTGCAACGTGA ATCACAAGCCCAGCAACAC CAAGTGGACAAGAGAGTT | CAGTGCAGCTGGTGGAGT CTGGGGGAGGCGTGGTCCA GCCTGGGAGGTCCCTGAGA CTCTCCTGTGCAGCCTCTGG ATTCACCTTCAGTAGCTATG CCATGCACTGGGTCCGCCA GGCTCCAGGGCAAGGGGCTG GAGTGGGTGGCAGTTATAT CATATGATGGAAGTAATAA ATACTCTGCAGACTCCGTG AAGGGCCGATTCACCATCT CCAGAGACAATTCCAAGAA CACGCTGTATCTGCAAATG AACAGCCTGAGAGCTGAGG ACACGGCTGTGTATTACTGT GCGAAAGGGGGGGCTACAG CTACTACTACTACGGTATGGA CGTCTGGGGCAAAGGGACC ACGGTCACCGTCTCCTCA (SEQ ID NO: 3551) | COV072_ P2_F3 | NNNNNNNNNNTATGNA TCNTACAACNTACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAACC CGGTGTACATTCTGACAT CCAGATGACCCAGTCTC CATCCTCCCTGTCTGCAT CTGTAGGAGACAGAGTC ACCATCACTTGCCAGGC GAGTCAGGACATTAGCA ACTATTTAAATTGGTATC AGCAGAAACCAGGGAAA GCCCCTAAGCTCCTGATC TACGATGCATCCAATTTG GAAACAGGGGTCCCATC AAGGTTCAGTGGAAGTG GATCTGGGACAGATTT ACTTTCACCATCAGCAGC CTGCAGCCTGAAGATAT TGCAACATATTACTGTCA ACAGTATGATAATCTCCC GCTCACTTTCGGCGGAG GGACCAAGGTGGAAATC AAACCTACGGTGGCTGC ACCATCTGTCTTCATCTT CCCGCCATCTGATGAGC AGTTGAAATCTGGAACT GCCTTCGTTGTGTGCCTG CTGAATAACTTCTATCCC AGAGAGGCCAAAGTACA GTGGAAGGTGGATAACG CCCTCCAATCGGGTAACT CCCAGGAGAGTGTCACA GAGCAGGACAGCAAGGA CAGCACCTACAGCCTCA GCAGCACCCTGACGCTG AGCAAAGCAGACTACGA GAAACACAAAGTCTACG | COV072_ P2_F3 |
| | | | | | AGATCAAAC (SEQ ID NO: 3553) | |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | original nt sequence | sequence ID (plate/well) |
| | GAGCCCAAATCTTGTGANN AAACTCACACATGCCCACC GTGCCCAGCACTCAACTN CTGGGGGACCGTCAGTCT TCCTCNTCCCCNAANCCN AGGACACCCNNCATGATCT NCCNNACCNNGAGTCACAT GCGTGNNNNNNGTNAGCAC GANANCCTGAGTCAGTCAN TGGNACNNNGNNGGNNNN GNNNNGCNTANNCNNANN NCNNNGGNAGNANCNNTAC ANNNNCGTACNNNNNGNC AGCNNNNTNNNCGTCNNNN CCNNGNNNGNNNNNAANGG NA (SEQ ID NO: 3550) | | | | |
| V-C040 | NNNNNNNATGNATCNTA CACATACGATTAGTGAC ACTATAGAATAACATCCAC TTTGCCTTTCTCTCCACAGG TGTCCACTCCAGGTCCAA CTGCACCTCGGTTCTATCGA TTGAATTCCACCATGGAT GGTCATGTATCATCCTTTTT CTAGTAGCAACTGCAACCG GTGTACATTCTGAGGTGCA GCTGGTGGAGTCTGGGGGA GGCTTGGTCCAGCCTGGG GGTCCCTGAGACTCTCCTGT GCAGCCTCTGAGTCACCG TCAGTAGCAACTACATGAG CTGGGTCCGCCAGGCTCCA GGGAAGGGCTGGAGTGGG TCTCACTTATTTATAGCGGT GGTAGCACATTCTACGCAG ACTCCGTGAAGGGCAGATT CACCATCTCCAGAGACAAT TCCGAGAACACGCTGTATC TTCAAATGAACACCCTGAG AGCCGAGGACACGGCTGTG | GAGGTGCAGCTGGTGGAGT CTGGGGGAGGCTTGGTCCA GCCTGGGGGTCCCTGAGA CTCTCCTGTGCAGCCTCTGG AGTCACCGTCAGTAGCAAC TACATGAGCTGGGTCCGCC AGGCTCCAGGGAAGGGGCT GGAGTGGGTCTCACTTATTT ATAGCGGTGGTAGCACATT CTAGTAGCAACTCCGTGAAG GCTGTACATTCTGAGGTGCA GGCAGATTCACCATCTCCA GAGACAATTCCGAGAACAC GCTGTATCTTCAAATGAAC ACCCTGAGAGCCGAGGAC ACGGCTGTGTATTACTGTGCG AGAGATCGTATTACTACG GTATGGACGTCTGGGGCCA AGGGACCACGGTCACCGT CTCCA (SEQ ID NO: 3555) | COV072_P2_C12 | NNNNNNNNNNGNAT CNTACACATACGATTTA GGTGACACTATAGAATA ACATCCACTTTGCCTTTC TCTCCACAGTGTCCACT CCCAGGTCCAACTGCAC CTCGGTTCTATCGATTGA ATTCCACCATGGGATGG TCATGTATCATCCTTTTT CTAGTAGCAACTGCAAC CGGTAGCATTCAGACA GAGACAATCAGCAGCCTCA GCCTGAAGATTTGCAACTT CATCACATCAGACAGAGTC CTGTAGGAGACAGAGTC ACCATACCTTGCCGGGC CAGTCAGGGCATTAGCA GTATTAGCCTGTGTATC AGCAAAAACCAGGAAA GCCCTAAGCTCCTGATC TATGCTGCATCCACTTTG CAAAGTGGGGTCCCATC AAGGTTCAGCGGCAGTG GATCTGGGACAGAATTC ACTCTGGGACCAAGCTGGAG ATCAAAC (SEQ ID NO: 3557) | GACATCCAGTTGACCCAGTC TCCATCCTTCCTGTCTGCAT CTGTAGGAGACAGAGTCAC CATCACTTGCCGGGCCAGTC AGGGCATTAGCAGTATTTA GCCTGGTATCAGCAAAAAC CAGGGAAAGCCCCTAAGCT CCTGATCTATGCTGCATCCA CTTTGCAAAGTGGGGTCCCA TCAAGGTTCAGCGGCAGTG GATCTGGGACAGAATTCACT CTCACAATCAGCAGCCTCA GCCTGAAGATTTGCAACTT ATTACTGTTCAACAGCTTAAT AGTTACTCTTACACTTTTGG CCAGGGGACCAAGCTGGAG ATCAAAC (SEQ ID NO: 3557) | COV072_P2_C12 |

TABLE 15-continued

Additional sequence information for the disclosed anti-SARS-CoV-2 antibodies

| | | HEAVY CHAIN | | LIGHT CHAIN | |
|---|---|---|---|---|---|
| ALICE | AbsID | miniprep sequence | original nt sequence | sequence ID (plate/well) | miniprep sequence | original nt sequence | sequence ID (plate/well) |
| | | TATTACTGTGCGAGAGATC TGTATTACTACGGTATGGA CGTCTGGGGCCAAGGGACC ACGGTCACCGTCTCCTCAG CGTCGACCAAGGGCCCATC GGTCTTCCCCCTGGCACCCT CCTCCAAGAGCACCTCTGG GGGCACAGCGGCCCTGGGC TGCCTGGTCAAGGACTACT TCCCCGAACCTGTGACGGT CTCGTGGAACTCAGGCGCC CTGACCAGCGGCGTGCACA CCTTCCCGGCTGTCCTACAG TCCTCAGGACTCTACTCCCT CAGCAGCGTGGTGACCGTG CCCTCCAGCAGCTTGGGCA CCCAGACCTACATCTGCAA CGTGAATCACAAGCCCAGC AACACCNANGTGACAAGA NAGTTGAGCCCAAATCTTG TGACAAAACTCACACATGC CCACCGTGCCCAGCACCTG AACTCCTGGGGGACCGTC AGTCTTCCTCTTCCCCCCAA AANCCAAGGACACACCCTNAT GATCNCCNGACCCCNGAN TCACATGCGTGGNGNNGAC GTGAGCCACGANACCCNGA GTCAGTTCAACTGGNACGN NGNNGGNNNNGGAGGTGC ANANNCNNNAANAAGCCN NNGGNAGGANNAGTANAN NGNNCGTACNNNNNNNNCA NCGTCNNCNNCNNNNNNNC AGNNTNNNGAANGGCNNG NNNNNNNANNGCAANGNN NNNCNNNNAANNNNN (SEQ ID NO: 3554) | | | CCTGCAGCCTGAAGATTT TGCAACTTATTACTGTCA ACAGCTTAATAGTTACTC TTACACTTTTGGCCAGGG GACCAAGCTGGAGATCA AACGTACGGTGGCTGCA CCATCTGTCTTCATCTTC CCGCCATCTGATGAGCA GTTGAAATCTGGAACTG CCTCTGTTGTGTGCCTGC TGAATAACTTCTATCCCA GAGAGGCCAAAGTACAG TGGAAGGTGGATAACGC CCTCCAATCGGGTAACTC CCAGGAGAGTGTCACAG AGCANGACAGCAAGGAC AGCACCTACAGCCTCAG NCAAAGCAGACTACGAG AAAACAAAGTCTACGC CTGCGAAGTCACCCATC AGGGCCTGAGCTCGCCC GTCACAAAGAGCTTCAA CAGGGAGAGTGTTAGA AGCTTGGCCGCCATGGC CCAACTTGTTATTGCAG CTTATAATGGNTACAAA TAAAGCAATAGCATCAC AAATTTCACAAATAAAG CATTTTTTTCACTGCATT CTANTTGNGNTTGNCC AAACTCATNNGNATNT NTCATGTCTGNATCNGN NNTNATTCGNCGCAGCN CNTNNNNAANNACNCTG AANAGNNNNNNNNACN NNGAGNGAANAACNTNN TGNGANNNNNNNNTCAGT NGGNNGNNGAAAGTCCC NNGNTNCCNANCAGNAN ANNNTGNNNCANGCATT NNCANNNNNNNNCNNCNG NNNNGGAAANTCNNNNN NNNN (SEQ ID NO: 3556) | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C041 | NNNNNNNNATGTATCNTA CACNTACGATTAGGTGAC ACTATAGAATAACATCCAC TTTGCCTTTCTCCACAGG TGTCCACTCCCAGGTCCAA CTGCACCTCGGTTCTATCGA TTGAATTCCACCATGGGAT GGTCATGTATCATCCTTTTT CTAGTAGCAACTGCAACCG GTGTACATTCGAGGTGCA GCTGTGGAGTCTGGGGGA GGCGTGGTCCAGCCTGGGA GGTCCCTGAGACTCTCCTGT GCAGCCTCTGGATTCACCTT CAGTAGCTATGCTATGTTCT GGGTCCGCCAGGCTCCGG CAAGGGCTGGAGTGGGTG GCAGTTATATCATATGATG GAAGCAATAAATACTACGC AGACTCCGTGAAGGGCCGA TTCACCATCTCCAGAGACA ATTCCAAGAACACGCTGTA TCTGCAAATGAACAGCCTG AGAGCTGAGGACACGGCTG TGTATTACTGTGCGAGGGC GGATTTAGGATATTGTACT AATGTGTATGCTATGTTG ACTACTGGGGCCAGGGAAC CCTGGTCACCGTCTCCTCAG CGTGACCAAGGGCCCATC GGTCTTCCCCCTGGCACCCT CCTCCAAGAGCACCTCTGG GGGCACAGCGGCCCTGGGC TGCCTGGTCAAGGACTACT TCCCCGAACCTGGTGACGGT CTCGTGGAACTCANGCGCC CTGACCAGCGGCGTGCACA CCTTCCCGGCTGTCCTACAG TCCTCAGGACTCTACTCCCT CAGCAGCGTGGTGACCGTG CCCTCCAGCAGCTTGGGCA CGTGAATCACCAAGCCAGC AACACCANNNGGACAAGA | CAGTGCAGCTGGTGGAGT CTGGGGGAGGCGTGGTCCA GCCTGGGAGGTCCCTGAGA CTCTCCTGTGCAGCCTCTGG ATTCACCTTCAGTAGCTATG CTATGTTCTGGGTCCGCCAG GCTCCAGGCAAGGGCTGG AGTGGGTGGCAGTTATATC ATATGATGGAAGCAATAAA TACTACGCAGACTCCGTGA AGGGCCGATTCACCATCTC CAGAGACAATTCCAAGAAC ACGCTGTATCTGCAAATGA ACAGCCTGAGAGCTGAGGA CACGGCTGTGTATTACTGTG CGAGGGCGGATTTAGGATA TGTTGACTACTGGGGCCA GGGAACCCTGGTCACCGTC TCCTCA (SEQ ID NO: 3559) | COV072_P3_H7 | NNNNNNNNNTATGCNAT CNTACACATACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTTCTTGGGCCAATTT TATGCTGACTCAGCCCCA CTCTGTGTCTGGAGTCTCC GGGGAAGACGGTAACCA TCTCCTGCACCCGGCAGC AGTGGCAGCATTGCCAG CAACTATGTGCAGTGGT ACCAGCAGCGTCCGGGC AGTGCCCCCACCACTGT GATCTATGAGGATAACC AAAGACCCCTCGGGGTC CCTGATCGGTTCTCTGGC TCCATGACAAGTCCTCC AACTTCTGCCTCCCTCACC ATCTCTGGACTCGAAGAC TGAGGACGAGGCTGACT ACTACTGTCAGTCTTATG ATAGCAGCAATTGGGTG TTCGGCGGAGGGACCAA GCTGACCGTCCTAGGTC AGCCCAAGGCTGCCCC TCGGTCACTCTGTTCCCG CCCTCGAGTGAGGAGCT TCAAGCCAACAAGGCCA CACTGGTGTGTCTCATAA GTGACTTCTACCCGGGA GCCGTGACAGTGGCCTG GAAGGCAGATAGCAGCC CCGTCAAGGCGGGAGTG GAGACCACCACCCCTC CAAACAAAGCAACAACA AGTACGCGGCCAGCAGC TACCTGAGCCTGACGCCT GAGCAGTGGAAGTCCCA | AATTTATGCTGACTCAGCC CACTCTGTGTCTGGAGTCTC CGGGGAAGACGGTAACCAT CTCCTGCACCGGCAGCAGTG GCAGCATTGCCAGCAACTAT GTGCAGTGGTACCAGCAGC GCCCGGGCAGTGCCCCCACC ACTGTGATCTATGAGGATAA CCAAAGACCCCTCGGGGTCC CTGATCGGTTCTCTGGCTCC ATCGACAGCTCCTCCAACTCTG TGCCTCCCTCACCATCTCTG GACTCGAAGACTGAGGACGA GGCTGACTACTACTGTCAGT CTTATGATAGCAGCAATTGG GTGTTCGGCGGAGGGACCA AGCTGACCGTCCTAG (SEQ ID NO: 310) | COV072_P3_H7 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | NAGTTGAGCCCAAATCTTG TGACAAAACTACACATGC CCACCGTGCCCAGCACCTG ACTCCTGGGGGACCGTCA GTCTTCNNNTCCCCCAAAA NCCAANNNANCCNTCATGA TCTNCCNNCCNNGAGTCAC NTGNNGTGGNGNNNGNNGT GANCNCNANANCCTGAGTC AGTCACTNNNCNTGNNNNN NNNGANNNGCNNANNCNN NNNNANCNNNGANNANAG TNCANNGNDNCNNNCNNNNN NGNCANCNNNNNNNNNC CGTNNNNNNNCNNNNGNA ANNNGGCNNNNN (SEQ ID NO: 3558) | | | CAGAAGCTACAGCTGCC AGGTCACGCATGAAGGG AGCACCGTGNNAAGAC AGTGGCCCCTACAGAAT GTTCATAGAAGCTTGGC CGCCATGGCCCAACTTGT TTATTGCAGCTTATAATG GTTACAAATAAAGCANA GCATCACAAATTTCACA AATAAAGCATTTTTTTCA CTGCATNCTANTNGNGG TTTGTCCAAACTCATCNN NNATNNNTCATGTCTGG ATCGGAATNNNTNGNC GCANCNCNTGCCTGANN ACCTCTGAANANNNTNN NGTACTNCNGAGNGAAA NNAANNTCTGNGNNNNNN GTCAGTTNGGNGNGNNN NNCCNGNTNCCCNNNNN GNANANNNTGCAAGCAT GCNTNNTNNNTNANTCA NN (SEQ ID NO: 3560) | | |
| V-C042 | | GAGGTGCAGCTGGTGGAGT CTGGGGGAGGCTTGGTCCA GCCGGGGGGTCCCTGAGA CTCTCCTGTGCAGCCTCTGG ATTCAGTGTCAGCACGAAG TACATGACATGGGTCCGTC AGGCTCCAGGGAAGGGACT GGAGTGGGTCTCAGCTCTTT ACACGCGGTGGTAGTGATTA CTACCAGACTCCGTGAAG GGCAGATTCACCATCTCCA GAGACAATTCCAAGAACAC TTTATATCTTCAAATGAGCA GCCTGAGAGTCGAGGACAC GGGTGTTTTATTACTGTGCCA GAGACTCGTGGAAGTCCG | COV047_P5_H7 | NNNNNNNNNTNNGNN TNNTACNCATACGATTTA GGTGACACTATAGAATA ACATTCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTGACATTCGGACA TCGTGATGACCCAGTCTC CAGACTCCCTGGCTGTGT CTGGGCGAGAGGGCC ACCATCAACTGCAAGTC CAGCAGAGTGTTTTATA | GACATCGTGATGACCCAGTC TCCAGACTCCCTGGCTGTGT CTNTGGGCGAGAGGGCCAC CATCAACTGCAAGTCCAGCC AGAGTGTTTTATACAGCTCC AACAATAAGAACTACTTAG CTTGGTACCAGCAGAAACC AGGACAGCCTCCTAAGCTGC TCATTTACTGGGCATCTACC CGGGAATCCGGGGTCCCTG ACCGATTCAGTGGCAGCGG GTCTGGGACAGATTTCACTC TCACCATCAGCAGCCTGCAG GCTGAAGATGTGCAGTTTA TTACTGTCAGCAATATATA GTACTCCGCTCACTTTCGGC | COV047_P5_H7 |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | | TGACCACCCCGGGCACCCA GGGCGCTCGGTGGGGCTT TTGATATTTGGGGCCAAGG GACAATGGTC (SEQ ID NO: 3562) | | CAGCTCCAACAATAAGA ACTACTTAGCTTGGTACC AGCAGAAACCAGGACAG CCTCCTAAGCTGCTCATT TACTGGGCATCTACCCG GGAATCCGGGGTCCCTG ACCGATTCAGTGGCAGC GGGTCTGGGACAGATTT CACTCTCACCATCAGCA GCCTGCAGGCTGAAGAT GTGGCAGTTTATTACTGT CAGCAATATTATAGTACT CCGCTCACTTTCGGCGGA GGGACCAAGGTGGAGAT CAAACGTACGGTGCTG CACCATCTGTCTTCATCT TCCCGCCATCTGATGAGC AGTTGAAATCTGGAACT GCCTCTGTTGTGTGCCTG CTGAATAACTTCTATCCC AGAGAGGCCAAAGTACA GTGGAAGGTGGATAACG CCCTCCAATCGGGTAACT CCCAGGAGAGTGTCACA GAGCAGGACAGCAAGGA CAGCACCTACAGCCTCA GCAGCACCCTGACGCTG AGCAAAGCAGACTACGA GAAACACAAAGTCTACG CCTGCGAAGTCACCCAT CANGGCCCTGAGCTCGCC CGTCACAAAGAGCTTCA ACAGGGGAGAGTGTTAG AAGTTGGCCGCCATGG CCCAACTTGTTTATTGCA GCTTATAATGGTTACAA ATAAAGCAATAGCATCA CAAATTTCACAAATAAA GCATTTTTTTCACTGCAT TCTANTTGTGGTTTGTCC AAACTCATCAATGTATCT NATCATGTCTGGATCGG GAATTNATTCGGCGCAG CANCATGGNCCTGAAAT AACCTNNNAAAGANNAC | GGAGGGACCAAGGTGGAGA TCAAAC (SEQ ID NO: 3564) | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | | | | TTGNTTAGNACNTNCTG ANNNNANNACATCNNNN GAATGNNNGTCANNNNN NGGNNGAAAGTCCCNNN CTCCCCNNCNGNNANNN TGCNNANNNNNNNNNNN NNNNCAGCACNGNNNGA ANNNNNNNNNNNNNNNN GCNAANNNNCANCANNN ANNNNNNNNNNNNNNN ANC (SEQ ID NO: 3563) | | |
| V-C043 | NNNNNNNNNATGNATCNT ACACATACGATTTAGGTGA CACTATAGAATAACATTCCA CTTTGCCTTTCTCCACAG GTGTCCACTCCCAGGTCCA ACTGCACCTCCGGTTCTATCG ATTGAATTCCACCATGGGA TGGTCATGTATCATCCTTT TCTAGTAGCAACTGCAACC GGTGTACATTCTGAGGTGC AGCTGGTGGAGTCTGGGG AGGCTTGGTCCAGCCGGGG GGGTCCCTGAGACTCTCCT GTGCAGCCTCTGGATTCAG TGTCACCAAGTACATG ACATGGGTCCGTCAGGCTC CAGGGAAGGGGCTGGAGTG GGTCTCAGTTCTTTACAGCG GTGGTAGTGATTACTACGC AGACTCCGTGAAGGGCAGA TTCACCATCTCCAGAGACA ATTCCAAGAACGCTTTATAT CTTCAAATGAACAGCTTGA GAGTCGAGGACACGGGTGT TTATTACTGTGCCAGAGACT CGTCGGAAGTCCGTGACCA CCCCGGGCACCCAGGCGC TCGGTGGGGCTTTTGATAT CTGGGGCCAAGGGACAATG GACCACCGTCTCTTCAGCGTC GACCAAGGGCCCATCGGTC TTCCCCCTGGCACCCTCCTC | GAGGTGCAGCTGGTGGAGT CTGGGGGAGGCTTGGTCCA GCCGGGGGGTCCCTGAGA CTCTCCTGTGCAGCCTCTGG ATTCAGTGTCAGCACATG TACATGACATGGGTCCGTC AGGCTCCAGGGAAGGGCT GGAGTGGGTCTCAGTTCTTT ACAGCGGTGGTAGTGATTA CTACGCAGACTCCGTGAAG GGCAGATTCACCATCTCCA GAGACAATTCCAAGAACGC TTTATATCTTCAAATGAACA GCTTGAGAGTCGAGGACAC GCTTGTGTTTATTACTGTGCCA GGGTGTTTTATTACTGTGCCA GAGACTCGTCGGAAGTCCG TGACCACCCCGGGCACCCA GGGGCTCGGTGGGGGCCTT TTGATATCTGGGGCCAAGG GACAATGGTCACCGTCTCTT CAG (SEQ ID NO: 3566) | COV047_ P5_E9 | NNNNNNNCCNNNNNNT ANNNNTACNCATACGATT TAGGTGACACTATAGAA TAACATCCACTTTGCCTT TCTCTCCAGGTGTCCA CTCCCAGGTCCAACTGC ACCTGGTTCTATCGATT GAATTCCACCATGGAT GGTCATGTATCACCTTT TTCTAGTAGCAACTGCA ACCGGTTCTGGGGTCA GTCTGCCCTGACTCAGCC TGCCTCCGTGTCTGGGTC TCCTGGACAGTCGATCA CCATCTCCTGCACTGGAA CCAGCAATGATGTTGGG AGTTATACCAACAGTACCC TGGTTACCCAAAGACC AGGCAAGCCCCCAAAC TCTTAATTTTTGAGGGCA CTAAGCGGTCCTCAGGG ATTTCTAATCGCTTCTCT GGTTCCAAGTCTGGCAA CACGGCCTCCCTGACAA TCTCTGGGCTCCAGGGTG AAGACGAGGCTGATTAT TATTGCTGCTCATATGCA GGTGCTAGCACTTTCGT TTCGGCGGAGGGACCAA GCTGACCGTCCTAGTC AGCCCAAGGCTGCCCCC TCGGTCACTCTGTTCCCA | CAGTCTGTGCTGACTCAGCC TGCCTCCGTGTCTGGGTCTC CTGGACAGTCGATCACCATC TCCTGCACTGGAACCAGCAA TGATGTTGGGAGTTATACCC TTGTCTCCTGGTACCAACAG TACCAGCAGAAGCCCCA AACTCTTAATTTTTGAGGGC ACTAAGCGGTCCTCAGGGAT TTCTAATCGCTTCTCTGGTTC CAAGTCTGGCAACACGGCCT CCCTGACAATCTCTGGGCTC CAGGGTGAAGACGAGGCTG ATTATTATTGCTGCTCATAT GCAGGTGCTAGCACTTTCGT GTTCGGCGGAGGGACCAAG CTGACCGTCCTAG (SEQ ID NO: 3568) | COV047_ P5_E9 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | CAAGAGCACCTCTGGGGGC | | | CCCTCGAGTGAGGAGCT | | |
| | | ACAGCGGCCCTGGGCTGCC | | | TCAAGCCAACAAGGCCA | | |
| | | TGGTCAAGGACTACTTCCC | | | CACTGGTGTCTCATAA | | |
| | | CGAACCTGTGACGGTCTCG | | | GTGACTTCTACCCGGGA | | |
| | | TGGAACTCAGGCGCCCTGA | | | GCCGTGACAGTGCCCTG | | |
| | | CCAGCGGCGTGCACACCTT | | | GAAGGCAGATAGCAGCC | | |
| | | CCCGGCTGTCCTACAGTCCT | | | CCGTCAAGGCGGGAGTG | | |
| | | CAGGACTCTACTCCCTCAG | | | GAGACCACCACACCCTC | | |
| | | CAGCGTGGTGACCGTGCCC | | | CAAACAAAGCAACAACA | | |
| | | TCCAGCAGCTTGGGCACCC | | | AGTACGCGGCCAGCAGC | | |
| | | AGACCTACATCTGCAACGT | | | TACCTGAGCCTGACGCCT | | |
| | | GAATCACAAGCCCAGCAAC | | | GAGCAGTGGAAGTCCCA | | |
| | | ACCAANGTGGACAAGAGAG | | | CAGAAGCTACAGCTGCC | | |
| | | TTGAGCCCAAATCTTGTGA | | | AGGTCACGCATGAAGGG | | |
| | | NNNAANTNANNCNNGNCCA | | | AGCACCGTGGAGAAGAC | | |
| | | TGNNCCGNCCGNGCCCAGN | | | AGTGGCCCCTACAGAAT | | |
| | | ACTNGNANNNCNNGGGGG | | | GTTCATAGAAGCTTGGC | | |
| | | GANCNNTCANNNTTNCNTC | | | CGCCATGGCCCAACTTGT | | |
| | | TTCCCCCAAAACCCANGG | | | TTATTGCAGCTTATAATG | | |
| | | ACACCNNCATGATCTCCCG | | | GTTACAAATAAAGCAAT | | |
| | | GACCCNTGAGTCANNNTGG | | | AGCATCACAAATTTCAC | | |
| | | CGATTTTTGGAGTGGTTATT | | | AGCTCATATACAAGCAG | | |
| | | CTAGAGACCGTTACTACTTT | | | CACCACTCGAGTCTTCGG | | |
| | | GACTACTGGGGCCAGGGAA | | | AACTGGGACCAGGGTCA | | |
| | | CCCTGGTCACCGTCTCCTCA | | | CCGTCCTAGGTCAGCCC | | |
| | | GCGTCGACCAAGGGCCCAT | | | AAGCCAACCCCACTGT | | |
| | | CGGTCTTCCCCCTGGCACCC | | | CACTCTGTTCCCACCCTC | | |
| | | TCCTCCAAGAGCACCTCTG | | | GAGTGAGGAGCTTCAAG | | |
| | | GGGGCACAGCGGCCCTGGG | | | CCAACAAGGCCACACTG | | |
| | | CTGCCTGGTCAAGGACTAC | | | GTGTGTCTCATAAGTGAC | | |
| | | TTCCCCGAACCTGTGACGG | | | TTCTACCCGGGAGCCGT | | |
| | | TCTGTGGAACTCANGCGC | | | GACAGTGCCTGGAAGG | | |
| | | CCTGACCAGCGGCGTGCAC | | | CAGATAGCAGCCCCGTC | | |
| | | ACCTTCCCGGCTGTCCTACA | | | AAGCGGGAGTGGAGAC | | |
| | | GTCCTCANGACTCTACTCCC | | | CACCACACCCTCCAAAC | | |
| | | TCAGCAGCGTGGTGACCGT | | | AAAGCAACAACAAGTAC | | |
| | | GCCCTCCAGCAGCTTGGGC | | | GCGGCCAGCAGCTACCT | | |
| | | ACCCAGACCTACATCTGCA | | | GAGCCTGACGCCTGAGC | | |
| | | ACGTGAATCACAAGCCCAG | | | AGTGGAAGTCCCACAGA | | |
| | | CAACACCNAAGGTGGACAA | | | AGCTACAGCTGCCAGGT | | |
| | | GANAGTTGAGCCCAAATCT | | | CACGCATGAAGGGAGCA | | |
| | | TGTGACAAAACTCACACAT | | | CCGTGGAGAAGACAGTG | | |
| | | GCCACCGTGCCCAGCACC | | | GCCCCTACAGAATGTTC | | |
| | | TGACTCCTGGGGGACCGT | | | ATAGAAGCTTGGCGCC | | |
| | | CAGTCTTCCTCTTCCCCCCA | | | ATGGCCCAACTTGTTTAT | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AACCCAAGGACACCCT TABLE 15-continued Additional sequence information for the disclosed anti-SARS-CoV-2 antibodies

| | | HEAVY CHAIN | | | LIGHT CHAIN | | |
|---|---|---|---|---|---|---|---|
| ALICE | AbsID | miniprep sequence | original nt sequence | sequence ID (plate/well) | miniprep sequence | original nt sequence | sequence ID (plate/well) |
| | | GGTCATGTATCATCCTTTTT | GGAGTGGGTCTCAGTTATTT | | GAATTCCACCATGGGAT | AACTCATGATTTATGATGTC | |
| | | CTAGTAGCAACTGCAACCG | ATAGCGGTGGTAGCACATA | | GGTCATGTATCATCCTTT | AGTAATCGGCCCTCAGGGGT | |
| | | GTGTACATTCTGAGGTGCA | CTACGCAGACTCCGTGAAG | | TTCTAGTAGCAACTGCA | TTCTAATCGCTTCTCTGGCT | |
| | | GCTGGTGGAGTCTGGAGGA | GGCCGATTCACCATCTCCA | | ACCGGTTCCTGGGCCCA | CCAAGTCTGGCAACACGGC | |
| | | GGCTTGATCCAGCCTGGGG | GAGACAAATCCAAGAACAC | | GTCTGCCCTGACTCAGCC | CTCCCTGACCATCTCTGGGC | |
| | | GGTCCCTGAGACTCTCCTGT | GCTGTATCTTCAAATGAAC | | TGCCTCCGTGTCTGGGTC | TCCAGGCTGAGGACGAGGC | |
| | | GCAGCCTCTGGGTTCACCG | AGGCTGAGAGCCGAGGACA | | TCCTGGACAGTCGATCA | TGATTATTACTGCAGCTCAT | |
| | | TCAGTAACAACTACATGAG | CGGCCGTGTATTATTGTGCG | | CCATCTCCTGCACTGGAA | ATACAAGCAGCAGCACTCG | |
| | | CTGGGTCCGCCAGGCTCCA | AGAGAAGGGGAGGTAGAA | | CCAGCAGTGACGTTGGT | AGTCTTCGGAACTGGGACCA | |
| | | GGGAAGGGGCTGGAGTGGG | GGGTATAACGATTTTTGGA | | GGTTATAACTATGTCTCC | AGGTCACCGTCCTAG (SEQ ID NO: 3572) | |
| | | TCTCAGTTATTTATAGCGGT | GTGGTTATTCTAGAGACCG | | TGGTACCAACAACACCC | | |
| | | GGTAGCACATACTACGCAG | TTACTACTTTGACTACTGGG | | AGGCAAAGCCCCCAAAC | | |
| | | ACTCCGTGAAGGGCCGATT | GCCAGGGAACCCTGGTCAC | | TCATGATTTATGATGTCA | | |
| | | CACCATCTCCAGAGACAAA | CGTCTCCTCAG (SEQ ID NO: 3570) | | GTAATCGGCCCTCAGGG | | |
| | | TCCAAGAACACGCTGTATC | | | GTTTCTAATCGCTTCTCT | | |
| | | TTCAAATAAACAGGCTGAG | | | GGCTCCAAGTCTGGCAA | | |
| | | AGCCGAGGACACGGCCGTG | | | CACGGCCTCCCTGACCAT | | |
| | | TATTATTGTGCGAGAGAAG | | | CTCTGGGCTCCAGGCTG | | |
| | | GGGAGGTAGAAGGGTATAA | | | AGGACGAGGCTGATTAT | | |
| | | CGATTTTTGGAGTGGTTATT | | | TACTGCAGCTCATATACA | | |
| | | CTAGAGACCGTTACTACTTT | | | AGCAGCAGCACTCGAGT | | |
| | | GACTACTGGGGCCAGGGAA | | | CTTCGGAACTGGGACCA | | |
| | | CCCTGGTCACCGTCTCCTCA | | | AGGTCACCGTCCTAGGT | | |
| | | GCGTCGACCAAGGGCCCAT | | | CAGCCCAAGGCCAACCC | | |
| | | CGGTCTTCCCCCTGGCACCC | | | CACTGTCACTCTGTTCCC | | |
| | | TCCTCCAAGAGCACCTCTG | | | ACCCTCGAGTGAGGAGC | | |
| | | GGGGCACAGCGGCCCTGGG | | | TTCAAGCCAACAAGGCC | | |
| | | CTGCCTGGTCAAGGACTAC | | | ACACTGGTGTGTCTCATA | | |
| | | TTCCCCGAACCTGTGACGG | | | AGTGACTTCTACCCGGG | | |
| | | TCTCGTGGAACTCAGGCGC | | | AGCCGTGACAGTGGCCT | | |
| | | CCTGACCAGCGGCGTGCAC | | | GGAAGGCAGATAGCAGC | | |
| | | ACCTTCCCGGCTGTCCTACA | | | CCCGTCAAGGCGGGAGT | | |
| | | GTCCTCANGACTCTACTCCC | | | GGAGACCACCACACCCT | | |
| | | TCANCAGCGTGGGGANNCN | | | CCAAACAAAGCAACAAC | | |
| | | GNNCNCCTCCANCANTTTG | | | AAGTACGCGGCCAGCAG | | |
| | | GGCNNCCNNAAANCTANNT | | | CTACCTGAGCCTGACGC | | |
| | | TNNGCAACGTNAANTCAAN | | | CTGAGCAGTGGAAGTCC | | |
| | | ANCCCAGCANCNNCCAAGG | | | CACAGAAGCTACAGCTG | | |
| | | NGNNNANAAAANTTGANCC | | | CCAGGTCACGCATGAAG | | |
| | | CAAATCTTGNGACAAAACT | | | GGAGCACCGTGGAGAAG | | |
| | | CACACATGCCCCANCGTGC | | | ACAGTGGCCCCTACAGA | | |
| | | CCAGCNCNGACTNCTGGGG | | | ATGTTCATAGAAGCTTG | | |
| | | GGACNTCAGTNTCNNTNCC | | | GCCGCCATGGCCCAACT | | |
| | | CNNAANCNNNNNNCCTNAT | | | TGTTTATTGCAGCTTATA | | |
| | | GATCNCCNNCCCNGAGTCA | | | ATGGTTACAAATAAAGC | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | NNTGNNNGTGNNGNNNTGA NCNNGANACCNGAGNCAGT CACTNNNCNTGNNGNNNNN NNGNNCANANNCNNANNA NCNNNNNNNNNNCANNNN NNGTNCNNGNNGTNNNNTC NNNCGTCNNNNNGNANTG NNNNNNNNNNNNNNNNN NNNNNNNNANCNNCNNN CNNNNAANNNNNNCNAN NCNNNNNNN (SEQ ID NO: 3569) | | | | | |
| V-C045 | NNNNNNNNNATGNNTCNTA CACATACGATTTAGGTGAC ACTATAGAATAACATCCAC TTTGCCTTTCTCTCCACAGG TGTCCACTCCCAGTCCAA CTGCACCTCGGTTCTATCGA TTGAATTCCACCATGGGAT GGTCATGTATCATCCTTTTT CTAGTAGCAACTGCAACCG GTGTACATTCTGAGTGCA GCTGGTGGAGTCTGGAGGA GGCTTGATCAGCCTGGGG GGTCCCCTGAGACTCTCCTGT GCAGCCTCTGGGTTCAGCG TCAGTAGCAACTACATGAG CTGGGTCCGCCAGGCTCCA GGGAAGGGGCTGGAGTGGG TCTCAGTTATTTATTAGCGGT GGTAGTACATACTACGCAG ACTCCGTGAAGGGCCGATT TCCAAGATCCAGAGACAAT TTCAATGAACACGCTGTATC TTCAAATGAACAGCCTGAG | GAGGTGCAGCTGGTGGAGT CTGGAGGAGGCTTGATCCA GCCTGGGGGGTCCCTGAGA CTCTCCTGTGCAGCCTCTGG GTTCAGCGTCAGTAGCAAC TACATGAGCTGGGTCCGCC AGGCTCCAGGGAAGGGGCT GGAGTGGGTCTCAGTTATT TATAGCGGTGGTAGTACATA CTACGCAGACTCCGTGAAG GGCCGATTCACCATCTCCA GAGACAATTCCAAGAACAC GCTGTATCTTCAAATGAAC AGCCTGAGAGCCGAGGACA CGGCCGTGTATTACTGTGC GAGAGAAGGGAGGTAGA AGTGGTTATTCTAGAGACC GTTACTACTTTGACTACTGG GGCCAGGGAACCCTGGTCA CCGTCCTCAG (SEQ ID NO: 315) | COV047_ P5_E1 | NNNNNCNNNTATGNATN NTACACATACGATTAGTAA GTGACACTATAGAATAA CATCCACTTTGCCTTTCT CTCCACAGTGTCCACTC CCAGTCCAACTGCACC TCGGTTCTATCGATTGAA TTCCACCATGGGATGGTC ATGTATCATCCTTTTTCT AGTAGCAACTGCAACCG GTTCCTGGGCCCAGTCTG CCCTGACTCAGCCTGCCT CCGTGTCTGGGTCTCCTG GACAGTCGATCACCATC TCCTGCACTGGAACCAGC CAGTCGACTTGGTGGTT ATAACTATGTCTCCTGGT ACCAACAACCAAGGC AAAGCCCCAAACTCAT GATTTATGATGTCAGTAA TCGGCCCTCAGGGGTTTC TAATCGCTTCTCTGGCTC CAAGTCTGGCAACACGG | CAGTCTGTGCTGACTCAGCC TGCCTCCGTGTCTGGGTCTC CTGGACAGTCGATCACCATC TCCTGCACTGGAACCAGCAG TGACGTTGGTGGTTATAACT ATGTCTCCTGGTACCAACAA CACCCAGGCAAAGCCCCA AACTCATGATTTATGATGTC AGTAATCGGCCCTCAGGGGT TTCTAATCGCTTCTCTGGCT CCAAGTCTGGCAACACGG CTCCCTGACCATCTCTGGGC TCGGTCTGAGGACGAGGC TGATTATTACTGCAGCTCAT ATACAAGCAGCACCACTCG AGTCTTCGGAACTGGGACCA GGGTCACCGTCCTAG (SEQ ID NO: 3576) | COV047_ P5_E1 |

TABLE 15-continued

Additional sequence information for the disclosed anti-SARS-CoV-2 antibodies

| ALICE AbsID | HEAVY CHAIN | | | LIGHT CHAIN | | |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TGCACACCTTCCCGGCTGTC<br>CTACAGTCCTTCAGGANTCT<br>ACTCCCTCAGCAGCTGGT<br>GACCGTGCCCTCCAGCAGC<br>TTGGGCACCCAGACCTACA<br>TCTGCAANGTGAANNNCAA<br>NCCCANNAACACCNNANGN<br>GNGANANNAGANNNNAGA<br>NCCNANATTNNTGAGANAA<br>AACTCACACATGCCCCACC<br>GTGCCCAGCANCTGAACTC<br>CTGGGGGACCGTCAGTCT<br>TCCTCNTCCCCAAACCCA<br>NNNCACCTCATGATCTCCN<br>GACCNNGANNCACNTGCGT<br>NNNNNNCGTGAGCCACGAN<br>ACCNGANTCAGTCACTNNN<br>CNNGNNGGCGTNNNNNCAT<br>ANGCNNACAAGCNCGGGA<br>GNNNAGTNNNANNGNNNG<br>TNCNNGNNGNCANCNTCNN<br>NCNTCCTGNNNNGNNNGNN<br>TNNNTGNNNNNNNTANNNN<br>NNNNGNNTCNNNNNANNN<br>NNNNNNNNNNNNNNNNN<br>CAANNNNNGNNNNNNNNA<br>NNCNNGNNTANCCNNNN<br>(SEQ ID NO: 3577) | | | GACAGTGGCCTGGAAGG<br>CAGATAGCAGCCCCGTC<br>AAGGCGGGAGTGGGAGAC<br>CACCACACCCTCCAAAC<br>AAAGCAACAACAAGTAC<br>GCGGCCAGCAGCTACCT<br>GAGCCTGACGCTCCAGC<br>AGTGGAAGTCCCACAGA<br>AGTACAGCTGCCAGGT<br>CACGCATGAAGGGAGCA<br>CCGTGAGAGACAGTG<br>GCCCCTACAGAATGNTC<br>ATAGAAGCTTGGCCGCC<br>ATGGCCAACTTGTTTAT<br>TGCANCTTATNATGTTA<br>CGNATANAGCAATAGCA<br>TCACNNTCNCACATTTCN<br>NANANNAANCTTTNTT<br>NTNNCTGCATTCTANTTN<br>NNGNNNGNNCNAACNT<br>CNNNNNNGNNTNCNTA<br>NNNNGNNNNGNNNCNN<br>NANNNANNNNNCANCA<br>CNTGNNNTGAAATNACN<br>NCTGAAGAGANTNNNNN<br>GTACTNCTGAGNNNANA<br>CNTCNGNGANGNNNNNC<br>ANTNGNNNNNNNNCCC<br>CNGNTNCCNNCAGNNNA<br>ANNNNGNANCATGCATN<br>NNATNNNNCNNNNNNGN<br>NNNGANNCCNNNNNNNN<br>NNNNGNNNNNTNNNNN<br>ANNNNNNNNNNNNNN<br>(SEQ ID NO: 3579) | | |
| V-C047 | NNNNNNNNNTATGNN<br>NNNACACATACGATTTAGG<br>TGACACTATAGAATAACAT<br>CCACTTTGCCTTTCTCCA<br>CAGGTGTCCACTCCCAGGT<br>CCAACTGCCACCTCGGTTCTA<br>TGGATCGGCTGGGTGCGCC<br>AGATGGGGATGGGGATCATC<br>GGATGGTCATGTATCATCCT<br>TTTCTAGTAGCAACTGCAA | GAGGTGCAGCTGGTGCAGT<br>CTGGAGCAGAGGTGAAAAA<br>GCCCGGGGAGTCTCTGAAG<br>ATCTCCTGTAAGGGTTCTGG<br>ATACAGATTTACCAACTAC<br>TGGATCGGCTGGGTGCGCC<br>AGATGGGCCGGGAAGGCCT<br>AGATGGGGATGGGGATCATC<br>TATCCTGGTGACTCTGATAC | COV047_<br>P3_H7 | NNNNNNNTTANGNATC<br>NTACACATACGATTTAG<br>GTGACACTATAGAATAA<br>CATCCACTTTGCCTTTCT<br>CTCCACAGGTGTCCACTC<br>CCAGGTCCAACTGCCACC<br>TCGGTTCTATCGATTGAA<br>TTCCACCATGGATGGTC<br>ATGTATCATCCTTTTTCT | CAGTCTGTGCTGACTCAGGA<br>GCCCTCACTGACTGTGTCCC<br>CAGGAGGACAGTCACTCT<br>CACCTGTGGCTCCAGCACTG<br>GAGCTGTCACCAGTGGTCAT<br>TATCCCTACTGGTTCCAGCA<br>GAAGCCTGGCCAAGCCCCC<br>AGGACACTGATTATGAAAC<br>AAGCATCAAACACTCCTGG | COV047_<br>P3_H7 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCGGTGTACATTCCGAGGT<br>GCAGCTGGTGCAGTCTGGA<br>GCAGAGGTGAAAAAGCCCG<br>GGGAGTCTCTGAAGATCTC<br>CTGTAAGGGTTCTGGATAC<br>AGATTTACCAACTACTGGA<br>TCGGCTGTGCGCCAGAT<br>GCCCGGGAAAGGCCTGGAG<br>TGGATGGGATCATCTATC<br>CTGGTGACTCTGATACCAG<br>ATACAGCCGTCTCTCCAA<br>GGCCAGGTCACCATCTCAG<br>CCGACCAAGTCCATCACCAC<br>CGCTTACCTGCAGTGGAGC<br>AGCCTGAAGGCCTCGACA<br>CCGCCATGTATTACTGTGCG<br>AGACTCAGTGACCGCTGGT<br>ACAGTCCGTTCGACCCCTG<br>GGGCCAGGAACCCTGGTC<br>ACCGTCTCCTCAGCGTGA<br>CCAAGGGCCCATCGGTCTT<br>CCCCCTGGACACCCTCCTCCA<br>AGAGCACCTCTGGGGGCAC<br>AGCGGCCCTGGGCTGCCTG<br>GTCAAGGACTACTTCCCCG<br>AACCTGTGACGGTTCGTG<br>GAACTCAGGCGCCCTGACC<br>AGCGGCGTGCACACCTTCC<br>CGGCTGTCCTACAGTCCTCA<br>GGACTCTACTCCCTCAGCA<br>GCGTGGTGACCGTGCCCTC<br>CAGCAGCTTGGGCACCCAG<br>ACCTACATCTGCAACGTGA<br>ATCACAAGCCCAGCAACAC<br>CAAGGTGGACAAGAGAGTT<br>GAGCCCAAATCTTGTGACA<br>AAACTCACACATGCCCACC<br>GTGCCCAGCACCTGAACTC<br>CTGGGGGGACCGTCAGTCT<br>TCCTCTTNCCCCNAAACCC<br>AAGGACACCCTCNTGATCT<br>CCCGACCCCTGANGTCAC<br>ATGCGTGGTGGTGGANGTG<br>AGCCACGANANCTGANG<br>NCAGGTCAACTGNTNNGTN | CAGATACAGCCCGTCCTTC<br>CAAGGCCAGGTCACCATCT<br>CAGCCGACAAGTCCATCAC<br>CACCGCCTACCTGCAGTGG<br>AGCAGCCTGAAGGCCTCGG<br>ACACCGCCATGTATTACTGT<br>GCGAGACTCAGTGACCGCT<br>GGTACAGTCCGTTCGACCC<br>CTGGGGCCAGGGAACCCTG<br>GTCACCGTCTCCTCAG<br>(SEQ ID NO: 3582) | | AGTAGCAACTGCAACCG<br>GTTCCAATTCCCAGGCTG<br>TGGTGACCACCAGGCCC<br>TCACTGACTGTGTCCCCA<br>GGAGGGACAGTCACTCT<br>CACCTGTGCTCCAGCA<br>CTGAGCTGTCACCAGT<br>GGTCATTATCCCTACTGG<br>TTCCAGCAGAAGTCTGG<br>CCAAGCCCCCAGGACAC<br>TGATTTATGAAACAAGC<br>ATCAAACACTCCTGAC<br>CCCTGCCCGGTTCTCAGG<br>CCCCTCCTTGGGGCAA<br>AGCTGCCCTGAACCCTTTC<br>GGGTGCGCAGCCTGAGG<br>ATGAGGCTGATTATTACT<br>GCTTGCTCTCCTATAGTG<br>GTGCTCGCCGGTTCG<br>GCGGAGGGACCAAGCTG<br>ACCGTCCTAGGTCAGCC<br>CAAGGCTGCCCCTCGG<br>TCACTCTGTTCCCACCCT<br>CGAGTGAGGAGCTTCAA<br>GCCAACAAGGCCACACT<br>GGTGTGTCTCATAAGTG<br>ACTTCTACCCGGGAGCC<br>GTGACAGTGCCTGAA<br>GGCAGATAGCAGCCCCG<br>TCAAGCGGGAGTGGAG<br>ACCACCACACCCTCCAA<br>ACAAAGCAACAACAAGT<br>ACGCGGCCAGCAGCTAC<br>CTGAGCCTGACGCTGA<br>GCAGTGGAAGTCCCACA<br>GAAGCTACAGTCGCCAG<br>GTCACGCATGAAGGGAG<br>CACCGTGGAGAAGACAG<br>TGGCCCCTACAGAATGTT<br>CATAGAAGCTTGGCCGC<br>CATGCCCAACTTGTTTA<br>TTGCAGCTTATAATGGTT<br>ACAAATAAAGCAATAGC<br>ATCACAAATTTCACAAA<br>TAAAGCATTTTTTCACT | ACCCCTGCCCGGTTCTCAGG<br>CTCCCTCCTTGGGGGCAAAG<br>CTGCCCTGACCCTTTCGGGT<br>GCGCAGCCTGAGGATGAGG<br>CTGATTATTACTGCTTGCTC<br>TCCTATAGTGGTGCTCGCCC<br>GGTGTTCGGCGGAGGGACC<br>AAGCTGACCGTCCTAG<br>(SEQ ID NO: 3584) | |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | GACGGCGCNGGANNTGNNN NTGNCAAGACNAANNNNAC ANGNNNNNNNNGANNNN NNNANGNNNNGNNNNNNN CNGGGNNNNNNNNNNNCN NCCCNNNNCNNGNNCNGA ANNNAGNNNNNNNGNN NGATNNNNNTNNNNGN NNNNCNNNNNCCCVTNCNN NNCNCNNTCNANAANNNNN NNNNNNCNAANNNGC NNNCCCNNCNNNAANNNN NNNGNNNGNNNNNNCN (SEQ ID NO: 3581) | | | GCATTCTANTTGTGTTN NNCCAAACTCATCAATG TATNNATCATGTNTGG NNCGGAATNANNNNNT NNNNNCNNCNNNNNNNN NNNNNNNNNNNNNNNA NNNNNNAANNNNANN NANNNNNNNNNNNNCN NNNNGNANGCNNAAAN NANCATNNTGNNNGNAN NNNNGNNNANTNNGGNN NNNANNTCCCNGNTCCC ANNNGNANAANTNTNNN NCNNNNNTNNNNNNCA NNNNNNNGNNNNNCN NANAGNNATNNNNNNNN NNNNNNNNNNCN NCNN (SEQ ID NO: 3583) | | |
| V-C048 | | NNNNNNNNNTGNATCNT ACACATACGATTAGGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTCTGCAACC GGTGTACATTCTGAGGTGC AGCTGGTGGAGTCTGGGGG AGGCTTGGTCCAGCCTGGG GGGTCCCAGAGACTCTCCT GTCAGCCCTCTGGATTCAC CGTCAGTAGCAATTACATG AGCTGGATCCGCCAGCTC CAGGGAAGGGCTGGAGTG GGTCTCAGTTATTTATAGCG GTGGTAGCCGTATACACGT AGACTCCGTGAAGGGCAGA TTCACCATCTCCAGAGACA ATTCCAAGAACACCCTGTA TCTTCAAATGAACAGCCTG AGACCCGAGGACACGGCTG | GAGGTGCAGCTGGTGGAGT CTGGGGGAGGCTTGGTCCA GCCTGGGGGTCCCAGAGA CTCTCCTGTGCAGCCTCTGG ATTCACCGTCAGTAGCAAT TACATGAGCTGGATCCGCC AGCTCCAGGGAAGGGCT GGAGTGGGTCTCAGTTATTT ATAGCGGTGGTAGCCGATA CTACGACTCCGTGAAG GGCAGATTCACCATCTCCA GAGACAATTCCAAGAACAC CCTGTATCTTCAAATGAAC AGCCTGAGACCCGAGGACA CGGCTGTGTATTACTGTGCG AGAATCGCAAACTACATGG ACGTCTGGGGCAAAGGGAC CACGGTCACCGTCTCCTCA (SEQ ID NO: 3586) | COV047_P3_B12 | NNNNNCNNATGNATNNT ACACATACGATTAGGT GACATATAGAATAACA TCCACTTTGCCTTTCTCT CCACAGGTGTCCACTCCC AGGTCCAACTGCACCTC GGTTCTATCGATTGAATT CCACCATGGGATGGTCA TGTATCATCCTTTTCTA GTAGCAACTCTGCAACCGG TGTCAACAGCAGTTCACT TGATGACGCAGTCTCCA GCCACCCGTCTGTGTCT CCAGGGGAAAGAGCCAC CCTCTCCTGCAGGGCCA GTCAGAGTGTTAGCAGC CACTTAGCCTGGTACCA GCAGAAACCTGGCCAGG CTCCCAGGCTCCTCATCT ATGGTGCATCCACCAGG GCCACTGGTATCCCAAC GGTTCAGTGGCAGTTC GGTCTGGGACAGAGTTC ACTCTCACCATCAGCAG | GAAATAGTGATGACGCAGT CTCCAGCCACCCTGTCTGTG TCTCCAGGGGAAAGAGCCA CCCTCTCCTGCAGGGCCAGT CAGAGTGTTAGCAGCCACTT AGCCTGGTACCAGCAGAAA CCTGGCCAGGCTCCCAGGCT CCTCATCTATGGTGCATCCA CCAGGGCCACTGGTATCCCA ACCAGGTTCAGTGGCAGTG GTGTCGGACAGAGTTCACT CTCACCATCAGCAGCCTGCA GTCTGAAGATTTTGCAGTTT ATTACTGCCAGCAGTATAAT AACTGGCCTCCGCTCACTTT CGGCGGAGGGACCAAGGTG GAGATCAAAC (SEQ ID NO: 3588) | COV047_P3_B12 |

TABLE 15-continued

| Additional sequence information for the disclosed anti-SARS-CoV-2 antibodies | | | | | | | |
|---|---|---|---|---|---|---|---|
| | | HEAVY CHAIN | | | LIGHT CHAIN | | |
| ALICE | AbsID | miniprep sequence | original nt sequence | sequence ID (plate/well) | miniprep sequence | original nt sequence | sequence ID (plate/well) |
| | | TGTATTACTGTGCGAGAATCGCAAACTACATGGACGTCTGGGGCAAAGGGACCACGGTCACCGTCTCCTCAGCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCTGTGACGGTCTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAGAGTTGAGCCCAAATCTTGTGACAAAACTNNNNNNNNNCCCCCGNNNCCNNNNCNCNNNNNCNNCNGGGGGNGANNNNNNANTNTTCTNNNTNCCCCCAAANCCNAGGNNNNCCNNNNNNNNNTTNNNCNNGNCCCNNNNNGNNNNNTGNGNGNGNNGGGNNNNNGNGNNCNAAAAANNCNCNNGAGNNNNNNTTNNNNNNNGNNNNNNNANNNNNNGNANGNNNNNTNANNNNNANANNNNCNGNNNNNANGNNNNNNNACAACNNNNCNTNCGNGNNNNNGNNNCTNNNNNTCNNNNCNNNACTNNNGNANGNANGNANNNNNNNANNNNNANNNNNNCNNNNNNNTNNNNCNTNNANNNNNNNNNNANNNNNNNNNCNNNNNNNNNNNGNGNANNNNN (SEQ ID NO: 3585) | | | CCTGCAGTCTGAAGATTTTGCAGTTTATTACTGCCAGCAGTATAATAACTGGCCTCCGCTCACTTTCGGCGGAGGGACCAAGGTGGAGATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTAGAAGCTTGGCCGCCATGGNNCCANNTNNNTNTATNNCAGNNNANAATGNNTNCAAATAAAGCNATANCATCACANATTTCACAAATAAAGCATTTTTTTCACTGCNTNCTAGTGTGGNTTGTNNNCANNNCNNNNNNNNNNNNNNNNNNNNCNNNNNNNNNNNNNNNNNNNNCGCANCACNNGNNNTNAAANTNNCTNNNNAANNNNNNNNNNNGNNNCNNNGAGGNNAANNANCNNNNNNNNNNNGTCANTNNGNNGNNNNNNNNNNCCNNNNGNNNANNNGNNANCNTNNNTNANNNNCNNNNNNNNNNNNCCNNNNNNANGNANNGNANCN (SEQ ID NO: 3587) | | |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| V-C049 | | NNNNNNNNNNNNNNN TCNTACACATGCAGATTTAG GTGACACTATAGAATAACA TCCACTTTGCCTTTCTCTCC ACAGGTGTCCACTCCCAGG TCCAACTGCACCTCGGTTCT ATCGATTGAATTCCACCAT GGGATGGTCATGTATCATC CTTTTTCTAGTAGCAACTGC AACCGGTGTACACTCCGTG GTGCAGCTGGTGGAGTCTG GGGAGGAGGCGTGGTCAGCC TGGGAGGGTCCCTGAGACTC TCCTGTGCAGCCCTCTGGATT CACCTTCAGTACCTATGGC ATGCACTGGGTCCGCCAGG CTCCAGGCCAAGGGGCTGGA GTGGGTGGCCGTTATATCA TATGATGGAAGTAATAAAT ACTTTGCAGACTCCGTGAA GGGCCGATTCACCATCTCC AGAGACAATTCCAAGAACA CGCTTTATCTGCAAATGAA CAGCCTGAGACCTGAGGAC ACGGCTGTATATTACTGTGC GAAAGTGGGGATGGAGTAC AGCAGTGGCTGGTACGGGG AAGAAATTGACTTCTGGGG CCAGGGAACCCTGGTCACC GTCTCCTCAGCGTCCTCC AGGGCCCATCGGTCTTCCC CCTGGCACCCTCCTCCAAG AGCACCTCTGGGGCTGCCTG CGGGCCCTGGCCTGGT CAAGGACTACTTCCCCGAA CCTGTGACGGTCTCGTGAA ACTCAGGCGCCCTGACCAG GCTGTCCTACAGTCCTCAG GACTCTACTCCCTCAGCAG CGTGTGACCGTGCCCTCC AGCAGCTTGGGCACCCAGA CCTACATCTGCAACGTGAA TCAAAGGCCAGCACCAACC | CAGTGCAGCTGGTGGAGT CTGGGGGAGGCGTGGTCCA GCCTGGGAGGGTCCCTGAGA CTCTCCTGTGCAGCCCTCTGG ATTCACCTTCAGTACCTATG GCATGCACTGGGTCCGCCA GGCTCCAGGCAAGGGGCTG GAGTGGGTGGCCGTTATAT CATATGATGGAAGTAATAA AACCGGTGTACACTCCGTG AAGGGCCGATTCACCATCT CCAGAGACAATTCCAAGAA CGCTTTATTTGCAAATGA ACAGCCTGAGACCTGAGGA CACGGCTGTATATTACTGTG CGAAAGTGGGGATGGAGTA CAGCAGTGGCTGGTACGGG GAAGAAATTGACTTCTGGG GCCAGGGAACCCTGTCAC CGTCTCCTCAG (SEQ ID NO: 3590) | COV047_ P5_F8 | NNNNNNNNNNATGNATCN TACANTACGATTTAGGT GACACTATAGAATAACA TCCACTTTGCCTTTCTCT CCACAGGTGTCCACTCCC AGTCCAACTGCACCTC GGTTCTATCCATTGAATT CCACCATGGGATGGTCA TGTATCATCCTTTTTCTA GTAGCAACTGCAACCGG GTACATTCTGACATCCAG ATGACCCAGTCTCCATCC TCCCTGTCTGCATCTGTA GGAGACAGAGTCACCAT CACTTGCCGGCAAGTC AGAGCATTAGCAGTTAT TAAATTGGTATCAGCA GAAACCAGGGAAAGTCC CCAAGCTCCTGATCTATG CTGCATCCAGTTTGCAAA GTGGGGTCCCATCAAGG TTCAGTGGCAGTGGATCT GGGACAGACTTCACTCT CACCATCAGCAGTCTGC AACTGAAGATTTTGCA ACTTACTACTGTCAACAG AGTTACAGAACCCCGCT CACTTTCGGCGGAGGGA CCAAGGTGGAGATCAAA CGTACGGTGGCTGCACC ATCTGTCTTCATCTTCCC GCCATCTGATGAGCAGT TGAAATCTGGAACTGCC TCTGTTGTGTGCCTGCTG AATAACTTCTATCCCAGA GAGGCCAAAGTACAGTG GAAGGTGGATAACGCCC TCCAATCGGGTAACTCCC AGGAGAGTGTCACAGAG CAGGACAGCAAGGACAG CACCTACAGCCTCAGCA GCACCCTGACGCTGAGC AAAGCAGACTACGAGAA ACACAAAGTCTACGCCT | GACATCCAGATGACCCAGTC TCCATCCTCCCTGTCTGCAT CTGTAGGAGACAGAGTCAC CATCACTTGCCGGGCAAGTC AGAGCATTAGCAGTTATTTA AATTGGTATCAGCAGAAAC CAGGGAAAGTCCCTAAGCT CCTGATCTATGCTGCATCCA GTTTGCAAAGTGGGGTCCCA TCAAGGTTCAGTGGCAGTGG ATCTGGGACAGACTTCACTC TCACCATCAGCAGTCTGCAA CCTGAAGATTTTGCAACTTA CTACTGTCAACAGAGTTACA GAACCCCGCTCACTTTCGGC GGAGGGACCAAGGTGGAGA TCAAAC (SEQ ID NO: 3592) | COV047_ P5_F8 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AAGGTGGACAAGAGAGTTG<br>AGCCCAAATCTTGTGACAA<br>AACTCACACATGCCCACCG<br>TGCCCAGCACCTGANNTCC<br>TGGGGGACCGTCAGTCTT<br>CCTCTTCCCCCAAAACCN<br>NNGACACCCTCATGATCNN<br>CCGGACCCCTGAGGTCACA<br>TGCGTGGTGGNNGGACGTG<br>AGCCACGAANANCCTGAGG<br>TCAAGTTCAACTGGNACNT<br>NNCGGCGNNGGNANGGNN<br>CATANATGNNCNNNNNNNN<br>NNNCNNNGGGNAGNANCA<br>GTTACAANCAGCNNCNTAC<br>NNGNTNGTGGTCANCNTCC<br>TCNCGTCNGCNNCANNNAN<br>TGNNVTTNAANNGNNAGGAN<br>NNCNAGNGNANGGGTNNN<br>CANNAANNCCNTNCCNNNC<br>CCCATTNNANAAAANNCNN<br>TNNNNNNNNNNGGNN<br>NAANCNNNCNNNNNNNNC<br>CCCNCNNNNNNCCNNGNNN<br>NNNN (SEQ ID NO: 3589) | | | | | |
| V-C050 | NNNNNNNNNATGNATNNT<br>ACNCATACGATTTAGGTGA<br>CACTATAGAATAACATCCA<br>CTTTGCCTTTTCTCTCCACAG<br>GTGTCCACTTCCCAGGTCCA<br>ATTCACCTTCAGTAGCTACT<br>GGATGCACTGGGTCCGCCA<br>AGTCCCAGGGAAGGGGCCG<br>GTGTGGGTCACATATTA<br>ACAGTGAAGGGAGTAGCAC<br>AAACTACGCGGACTCCGTG<br>AGGGGCCGATTCACCATCT<br>CCAGAGACAACGCCAAGA<br>CACGCTATATCTTCAAATG<br>AACAATCTGAGAGCCGAGG<br>ACACGGCTGTATATTACTGT | GAGGTGCAGCTGGTGGAGT<br>CCGGGGGAGGCTTAGTTCA<br>GCCTGGGGGGTCCCTGAGA<br>CTCTCCTGTGTAGCCCTCTGG<br>ATTCACCTTCAGTAGCTACT<br>GGATGCACTGGGTCCGCCA<br>AGTCCCAGGGAAGGGGCCG<br>GTGTGGGTCTCACATATTA<br>ACAGTGAAGGGAGTAGCAC<br>AAACTACGCGGACTCCGTG<br>AGGGGCCGATTCACCATCT<br>CCAGAGACAACGCCAAGA<br>CACGCTATATCTTCAAATG<br>AACAATCTGAGAGCCGAGG<br>ACACGGCTGTATATTACTGT | COV047_<br>P3_C1 | NNNNNNNNATGNATCN<br>TACCATACGATTTAGGT<br>GACACAGTGATCACCATC<br>TCCACTTTGCCTTTCTCT<br>CCACAGGTGTCCACTCCC<br>AGTTCTATCTGCACCTC<br>GGTTCTCATCGATTGAATT<br>CCACCATGGGATGGTCA<br>TGTATCATCCTTTTCTA<br>GTAGCAACTGCAACCGG<br>TTCCTGGCCCAGTCTGC<br>CCTGACTCAGCCTGCCTC<br>CGTGTCTGGGTCTCCTGG<br>ACAGTCGATCACCATCTC<br>CTGCACTGGAACCAGCA<br>(SEQ ID NO: 3591) | CAGTCTGTGCTGACTCAGCC<br>TGCCTCCGTGTCTGGGTCTC<br>CTGGACAGTCGATCACCATC<br>TCCTGCACTGGAACCAGCAG<br>TGACGTTGGTTATTATAACT<br>TTGTCTCCTGGTACCAACAA<br>CACCCAGGCAAAGCCCCA<br>AACTCATGATTTATGAGTC<br>AGTAATCGGCCCTCTGGGT<br>TTCTAATCGGCTTCTCTGCT<br>CCAAGTCTGGCAACACGGC<br>CTCCCTGATCATCTCTGGG<br>TCCAGGCTGAGGACGAGGC<br>TGATTATTACTGCAGCTCAT<br>ATAGAAGCAGCAGCACTCT | COV047_<br>P3_C1 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | ACTGGGTCCGC TABLE 15-continued Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | | NNNNNNNNNNNCTNNCCN NNCNNNNNNNNNNANNGN NNANGGNNNANGNNNNNNN ANNNNNNNANANNNNNNN NANCATGNANNNTTNANCN NNNNNNNNCNNNNNNN (SEQ ID NO: 3593) | | | TCNNNNGANNNNNNCNN NGANGANGNNGNNNNTN GGNGNNNNANNNNNCN NNCNNCNNNNNGNNNNNN NNNCNNNCNTNCNNNNN NNNNNNNNNNNNNN NNNNCNNNGNCCNNNNN GNNNNTGNNNNNNNN (SEQ ID NO: 3595) | | |
| V-C051 | | NNNNNCNNATGNATCNTA CACATACGATTTAGGTGAC ACTATAGAATAACATCCAC TTGCCTTTCTCTCCACAGG TGTCCACTCCCAGGTCCAA CTGCACCTCGGTTCTATCGA TTGAATTCCACCATGGGAT GGTCATGTATCATCCTTTTT CTAGTAGCAACTGCAACCG GTGTACATTCTGAGGTGCA GCTGGTGGAGTCTGGGGGA GGCTTGGTCAAGCCTGGGG GGTCCCTGAGACTCTCCTGT GCAGCCTCTGATTCACCTT CAGTAGCTATAACATGAAC TGGGTTCCGCCAGGCTCCAG GGAAGGGGTCGGAGTGGGT CTCATGCATTAGTAGTAGT AGTAGTTACATATACTACG CAGACTCAGTGAAGGGCCG ATTCACCATCTCCAGAGAC AACGCCAAGAACTCACTGT ATCTGCAAATGAACAGCCT GAGAGCCGAGGACACGGCT GTGTATTACTGTGCGAGAG AGAGGAGGGTATGACGGTGG TAAAACCCCCATTTCTTG GGGGCCAGGAACCCTGGT CACCGTCTCCTCAGCGTCG ACCAAGGGCCCATCCGTCT TCCCCCTGGCACCCTCCTC AAGAGCACCTCTGGGCTCCCT GGTCAAGGACTACTTCCCC GAACCTGTGACGGTCTCGT | GAGGTGCAGCTGGTGGAGT CTGGGGGAGGCCTGGTCAA GCCTGGGGGGTCCCTGAGA CTCTCCTGTGCAGCCTCTGG ATTCACCTTCAGTAGCTATA ACATGAACTGGGTCCGCCA GGCTCCAGGGAAGGGGCTG GAGTGGGTCTCATGCATTA GTAGTAGTAGTAGTTACAT ATACTACGCAGACTCAGTG AAGGGCCGATTCACCATCT CCAGAGACAACGCCAAGAA CTCACTGTATCTGCAAATG AACAGCCTGAGAGCCGAGG ACACGGCTGTGTATTACTGT GCGAGAGAGGAGGGTATG ACGGTGGTAAAACCCCCCC ATTTCTTGGGGCCAGTGGT AG (SEQ ID NO: 3598) | COV047_ P5_B12 | NNNNNNNNNNNATGAT CNTACNCATACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTTCTTGGGCCAATTT TATGCTGACTCAGCCCCA CTCTGTGTCCGAGTCTCC GGGGAAGACGTAACCA TCTCCTGCACCCGCAGC AGTGGCAGCATTGCCAGT CAACTATGTGCAGTGGT CAACCAGCAGCCCCGGC AGTGCCCCACCACTGT GATCTATGAGGATAACC AAAGACCCTCTGGGGTC CCTGATCGGTTCTCTGGC TCCATGCAGAGCTCCTCC AACTCTGCCTCCCTCACC ATCTCTGGACTGAAGAC TGAGGACGAGGCTGACT ACTACTGTCAGTCTTATG ATAGCAGCAATTATTGG GTGTTCGGCGGAGGGAC CAAGCTGACCGTCCTAG GTCAGCCCAAGGCTGCC CCCTCGGTCACTCTGTTC CCGCCCTCGAGTGAGGA GCTTCAAGCCAACAAGG CCACACTGGTGTGTCTCA | AATTTATGCTGACTCAGCC CCACTCTGTGTCCGAGTCTC CGGGGAAGACGTAACCAT CTCCTGCACCCGGCAGCAGTG GCAGCATTGCCAGCAACTAT GTGCAGTGGTACCAGCAGC GCCCGGGCAGTGCCCCACC ACTGTGATCTATGAGGATAA CCAAAGACCCTCTGGGGTCC CTGATCGGTTCTCTGGCTCC ATCGACAGCTCCTCCAACTC TGCCTCCCTCACCATCTCTG GACTGAAGACTGAGGACGA GGCTGACTACTACTGTCAGT CTTATGATAGCAGCAATTAT TGGGTGTTCGGCGGAGGGA CCAAGCTGACCGTCCTAG (SEQ ID NO: 3600) | COV047_ P5_B12 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE AbsID | | miniprep sequence | original nt sequence | sequence ID (plate/well) | miniprep sequence | original nt sequence | sequence ID (plate/well) |
| | | GGAACTCAGGCGCCCTGAC<br>CAGCGGCGTGCACACCTTC<br>CCGGCTGTCCTACAGTCCTC<br>AGGACTCTACTCCCTCAGC<br>AGCGTGGTGACCGTGCCCT<br>CCAGCAGCTTGGGCACCCA<br>GACCTACATCTGCAACGTG<br>AATCACAAGCCCAGCAACA<br>CCNANNTGGACAAGAGAGT<br>TGAGCCCCAATCTTGTGAC<br>AAAACTCACACATCCACAC<br>CGTGCCCANCACCTGNANT<br>CNNNNGGGGAGGGNNNG<br>TCTTNTTNTTNNTCNNCCCN<br>NCCNAAANNNNAGGANNN<br>NCNTNNTNNTTNNCCCGGA<br>CCNNNTGANGNTNNCNNGGN<br>GTGGGGGNGGNNNNNTGN<br>NNNACNAANNCCCNGNAG<br>GTCAAGTTCAACTGGNACG<br>TGGNCGGNNTNNNNTGCNN<br>NNNNCAANAANNAAGCCG<br>CNGGANGNNNNNTANANA<br>GCACNNACCGNNGNGNNN<br>NNCNNCNTCNCCGTCNGNN<br>NNNNNTNNNANNGNANN<br>NNNAANNNNNNNNNNNNAN<br>ANCNTNCNNNNCCNNNGNN<br>NACNNNCAANNNCANNNN<br>NNNCNNNNANNNNNNNTA<br>NNNNCNNNNCCCNCNCNNN<br>(SEQ ID NO: 3597) | | | | |
| V-C052 | | NNNNNNNNNTGNATCNTAC<br>ACATACGATTTAGGTGACA<br>CTATAGAATAACATCCACT<br>TGCCTTTCTCTCCACAGGT<br>GTCCACTCCCAGGTCCAAC | CAGGTTCAGCTGGTGCAGT<br>CTGGAGCTGAGGTGAAGAA<br>GCCTGGGGCCTCAGTGAAG<br>GTCTCCTGCAAGGCTTCTGG<br>TTACACCTTTACCAGCTACG | COV047_<br>P3_A10 | NNNNNNNNNATGNATNN<br>TACACATACGATTTAGGT<br>GACACTATAGAATAACA<br>TCCACTTGCCTTTCTCT<br>CCACAGGTCCACTCCC<br>(SEQ ID NO: 3599) | GACATCCAGATGACCCAGTC<br>TCCATCCTCCCTGTCTGCAT<br>CTGTAGGAGACAGAGTCAC<br>CATCACTTGCCGGGCGAGTC<br>AGGGCATAAGCAATTACTTA | COV047_<br>P3_A10 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | TGCACCTCGG TABLE 15-continued Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | NNNNCCCTATGATCTCCG ACCCTGAGTCANNTGCGTG NGNGNCGTGANCNCNANAN CNTGANGNCAGTCANTGNA CNTGNNGGNNNNNGNNC NTANNCANANNANCNNNG GAGNNNANTNNANNNNNN GNNNCNNNNNGNNANCNN CNNNCNNNCNNNNNNNNNN NTGNNNNANNNNNNNAN NNNNNNNNNNNNNNNNAN NNNNNNNNNNNNNNNNNC NTNNAANCNNNGGGNNNC NCNNNNA (SEQ ID NO: 3601) | | | TTATAATGNTACAAAT AAAGCAATAGCATCACA AATTCACAAATAAAGC ATTTTTTCACTGCATTC TAGTTGTGTTTGTCCAA ACTCATCAATGTATNTNT CATGTCTGGATCGGNAN TNANTNGNGCAGNNCNT NNNTGAAANACNCTGAA NAGNNNTNNNNNNGTAC TNCTGAGNGNAGANNNN CNNNGANNNNNGTCANN NNNNGGNGNANNNNCCN NNGCNNNCNNCNGNNNA NNNNNNAGCATGCNTN CNNNNNNNNNCNNNNNN NGNAGNNNACNNNCNNN NNNNGNNNNNNNNNN GCNANNNNNNCNNNNNN TN (SEQ ID NO: 3603) | | |
| V-C053 | NNNNNNNNTTATGTATCNT ACACATACGATTAGGTGA CACTATAGAATAACATCCA CTTTGCCTTTTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACATTCTGAGGTGC AGCTGGTGGAGTCTGGAGG AGGCTTGATCCAGCCTGGG GGGTCCCTGAGACTCTCCT GTGCAGCCTCTGGGTTCAC CGTCAGTAGCAACTACATG AGCTGGGTCCGCCAGGCTC CAGGGAAGGGGCTGGAGTG GGCCTCAGTTATTTATAGCG GTTATAGCACATACTACGT AGACTCCGTGAAGGGCCGA TTCACCATCTCCAGAGACA ATTCCAAGAACACGCTGTA TCTTCAAATGAACAGCCTG | GAGGTGCAGCTGGTGGAGT CTGGAGGAGGCTTGATCCA GCCTGGGGGGTCCCTGAGA CTCTCCTGTGCAGCCTCTGG GTTCACCGTCAGTAGCAAC TACATGAGCTGGGTCCGCC AGGCTCCAGGGAAGGGGCT GGAGTGGGTCTCAGTTATT TATAGCGGTTATAGCACATA CTACGTAGACTCCGTGAAG GGCCGATTCACCATCTCCA GAGACAATTCCAAGAACAC GCTGTATCTTCAAATGAAC AGCCTGAGAGCCGAGGACA GCTGTATTTCAAATGAAC CGGCCGTGTATTACTGTGC GAGATGGGGGAGCACAT AGTGGCTACGACGGATCCT TTGACTACTGGGGCCAGGG AACCCTGGTCACCGTCTCCT CAG (SEQ ID NO: 3606) | COV047_ P5_E10 | NNNNNNCNNATGNATNN TACACATACGATTAGGT GACACTATAGAATAACA TCCACTTTGCCTTTCTCT CCACAGGTGTCCACTCCC AGGTCCAACTGCACCTC GGTTCTATCGATTGAATT CCACCATGGGATGGTCA TGTATCATCCTTTTTCTA GTAGCAACTGCAACCGG GGCCGATTCACCATCTGC CCTGACTCAGCCTGCCTC CGTGTCTGGGTCTCCTGG ACAGTCGATCACCATCTC CTGCACTGGAACCAGCA GTGATGTTGGGAGTTAT AACCTTGTCCTGGTAGCACTTGG GTGTTCGGCGGAGGGACCA AGCTGACCGTCCTAG (SEQ ID NO: 3608) | CAGTCTGCCCTGACTCAGCC TGCCTCCGTGTCTGGGTCTC CTGGACAGTCGATCACCATC TCCTGCACTGGAACCAGCAG TGATGTTGGGAGTTATAACC TTGTCCTGGTACCAACAG CACCCAGGCAAAGCCCCA AACTCATGATTTATGAGGGC AGTAAGCGGCCCTCAGGGG TTTCTAATCGCTTCTCTGGCT CCAAGTCTGGCAACACGGC CTCCCTGACAATCTCTGGGC TCCAGGTCTGAGGACGAGGC ACAGTGGATCACCATCTC TGATTATTACTGCTGCTCAT ATGCAGGTAGTAGCACTTGG GTGTTCGGCGGAGGGACCA AGCTGACCGTCCTAG (SEQ ID NO: 3608) | COV047_ P5_E10 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AGAGCCGAGGACACGGCCG TGTATTACTGTGCCGAGAGT GGGGGGACACATAGTGGC TACGACGGATCCTTTGACT ACTGGGGCCAGGGAACCCT GGTCACCGTCTCCTCAGCGT CGACCAAGGGCCCATCGGT CTTCCCCCTGGCACCCTCCT CCAAGAGCACCTCTGGGGG CACAGCGGCCCTGGGCTGC CTGGTCAAGGACTACTTCC CCGAACCTGTGACGGTCTC GTGGAACTCAGGCGCCCTG ACCAGCGGCGTGCACACCT TCCCGGCTGTCCTACAGTCC TCAGGACTCTACTCCCTCAG CAGCGTGGTGACCGTGCCC TCCAGCAGTTGGGCACCC AGACCTACATCTGCAACGT GAATCACAAGCCCAGCAAC ACCAAGGTGGACAAGAGAG TTGAGCCCAAATCTTGTGA CAAAACTCACACATGCCCA CCGTGCCCAGCACCTGAAC TCCTGGGGGACCGTCAGT CTTCCTCTTCCCCCCAAAAC CCAAGGACACCCTCATGAT CTCCCGGACCCCTGANNCA CATGCGTGGTGGNGGACGT GAGCCACGAAGACCTGANN CAAGTTCANTGGTACNTGG NNNGCNTGNNNGCATGATG NCNNNANNANNCNNNNNA GANNNGTNNNNNANNANN TANCNGGNNNNNNCNGTG NNNGNNCNNNNNTNCNCNN NNCTNNNNNNANNNGGG NNNNANNGGNANNNNNNN NNNNNNANNGGNNTNNNN NNAANNNNNNNNNCNNNN NNNNANNNNNNNNNNNN NNNNNNNAAANCNNNNN GGNNNNNCCCN (SEQ ID NO: 3605) | | | CTCCCTGACAATCTCTGG GCTCCAGGCTGAGGACG AGGCTGATTATTACTGCT GCTCATATGCAGGTAGT AGCACTTGGGTGTTCGG CGGAGGGACCAAGCTGA CCGTCCTAGGTCAGCCC AAGGCTGCCCCCTCGGT CACTCTGTTCCCACCCTC GAGTGAGGAGCTTCAAG CCAACAAGGCCACACTG GTGTGTCTCATAAGTGAC TTCTACCCGGAGCCGT GACAGTGGCCTGGAAGG CAGATAGCAGCCCCGTC AAGGCGGGAGTGGAGAC CACCACACCCTCCAAAC AAAGCAACAACAAGTAC GCGACCAGCAGCTACCT GAGCCTGACGCCTGAGC AGTGGAAGTCCCACAGA AGCTACAGCTGCCAGGT CACGCATGAAGGGAGCA CCGTGAGAAGACAGTG GCCCCTACAGAATGTTC ATAGAAGCTTGGCCGNC NNNGNCCNANNTTNGTT ANNTNNNNNNTTANNNN GNTTACANATAANGCNA TANTCATCACANATTTTC ACANAATAANAGNNNTT TTNTNNCTGNNNNTCTA GTNGTGNGTTNTGNNNA NNTCNNCNTCAGTGTAT CATNANNGTNTNNNNNA TCGANNANTTANNTNNN CGCANCNNNNNNGNCNGN AANNNNCNNNTNNNNNN NNNNNNNNAGNNCTNCT GAGNNNNNNCNTCNGN GNNNGNNNNNCAGTNGNN CNNNNNNNCCNNNNCCN NCAGCNNANNNGCANNC ATNNNTNNANNANNNN NNNNNNAGTCCNGNC | | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C054 | NNNNNNNNNNNNN NNNTACACNTACGATTTAG GTGACACTATAGAATAACA TCCACTTTGCCTTTCTCTCC ACAGGTGTCCACTCCCAGG TCCAACTGCACCTCGGTTCT ATCGATTGAATTCCACCAT GGGATGGTCATGTATCATC CTTTTTCTAGTAGCAACTGC AACCGGTGTACATTCTCAG GTGCAGCTGGTGAGTCTG GGGAGGCGTGGTCCAGCC TGGAGGTCCCTGAGACTC TCCTGTGCAGCCTCTTGGATT CACTTCAGTCGTATGCC ATGCACTGGGTCCGCCAGG CTCCAGGCAAGGGCTGGA GTGGGTGGCAGTTATGTCA TATGATGGAAGTAGTAAAT ACTATGCAGACTCCGTGAA GGGCCGATTCACCATCTCC AGAGACAATTCCAAGAACA CGCTGTCTCTGCAAATGAA CAGCCTGAGAGCTGAGGAC ACGGCTGTGTATTACTGTGC GAAACAGGCGGGCCCATAT TGTAGTGGTGGTAGCTGCT ACTCCGGCGCCCTTTGACTAC TGGGGCCAGGGAACCCTGG TCACCGTCTCCTCAGCGTCG ACCAAGGGCCCATCGGTCT TCCCCCTGGCACCCTCCTCC AAGAGCACCTCTGGGGGCA CAGCGCCCTGGGCTGCCT GGTCAAGGACTACTTCCCC GAACCTGTGACGGTCTCGT GGAACTCAGCGCCCTGAC CAGCGGCGTGCACACCTTC CCGGCTGTCCTACAGTCCTC AGCAGCTTACTCCCTCAGC AGCGTGGTGACCGTGCCCT | CAGGTGCAGCTGGTGGAGT CTGGGGGAGGCGTGGTCCA GCCTGGAGGTCCCTGAGA CTCTCCTGTGCAGCCTCTGG ATTCACCTTCAGTCGCTATG GCATGCACTGGGTCCGCCA GGCTCCAGGCAAGGGCTG GAGTGGGTGGCAGTTATGT CATATGATGGAAGTAGTAA ATACTATGCAGACTCCGTG AAGGGCCGATTCACCATCT CCAGAGACAATTCCAAGAA CACGCTGTCTCTGCAAATG AACAGCCTGAGAGCTGAGG ACACGGCTGTGTATTACTGT GCGAAACAGGCGGGCCCAT ATTGTAGTGGTGGTAGCTG CTACTCCGGCGCCCTTTGACT ACTGGGGCCAGGGAACCCT GGTCACCGTCTCCTCAG (SEQ ID NO: 3610) | COV047_P5_H7 | NNNGNNNNNANNNN NNNNNNNNN (SEQ ID NO: 3607) NNNNNNNNNTGNATCN TACACATACGATTTAGGT GACACTATAGAATAACA TCCACTTTGCCTTTCTCT CCACAGGTGTCCACTCCC AGGTCCAACTGCACCTC GGTTCTATCGATTGAATT CCACCATGGGATGGTCA TGTATCATCCTTTTCTA GTAGCAACTGCAACCGG GTACAACTGCAACCGG TGTACATTCTGACATCCA GATGACCCAGTCTCCATC CTCCCTGTCTGCACTCGT AGGAGACAGAGTCACCA TCACTTGCCAGGCGAGT CAGGCATTAGCAACTA TTTAAATTGGTATCAGCA GAAAccAGGGAAAGcCC CTAAGCTCCTGATCTACG ATGCATCCAATTTGGAA ACAGGGGTCCCATCAAG GTTCAGTGGAAGTGGAT CTGGGACAGATTTTACTT TCACCATCAGCAGCCTG CAGCCTGAAGATATTGC AACATATTACTGTCAAC AGTATGATAATCTCCCG ATCACCTTCGGCCAGG GACACGACTGGAGATTA AACGTACGGTGGCTGCA CCATCTGTCTTCATCTTC CCGCCATCTGATGAGCA GTTGAAATCTGGAACTG CCTCTGTCTGTGTGCCTGC TGAATAACTTCTATCCCA GAGAGGCCAAAGTACAG TGGAAGGTGATAACGC CCTCCAATCGGGTAACTC CCAGGAGAGTGTCACAG AGCAGGACAGCAAGGAC AGCACCTACAGCCTCAG | GACATCCAGATGACCCAGTC TCCATCCTCCCTGTCTGCAT CTGTAGGAGACAGAGTCAC CATCACTTGCCAGGCGAGTC AGGGCATTAGCAACTATTTA AATTGGTATCAGCAGAAAC CAGGAAAGCCCCTAAGCT CCTGATCTACGATGCATCCA ATTTGGAAACAGGGGTCCC ATCAAGGTTCAGTGGAAGT GGATCTGGGACAGATTTTAC TTTCACCATCAGCAGCCTGC AGCCTGAAGATATTGCAAC ATATTACTGTCAACAGTATG ATAATCTCCCGATCACCTTC GGCCAAGGGACACGACTGG AGATTAAAC (SEQ ID NO: 3612) | COV047_P5_H7 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CCAGCAGCTTGGGCACCCA GACTTACATCTGCAACGTG AATCACAAGCCCAGCAACA CCAAGGTGGACAAGAGAGT TGAGCCCAAATCTTGTGAC AAAACTCACACATGCCCAC CGTGCCCAGCACCTGAACT CCTGGGGGACCGTCAGTC TTCCTCTTCCCCCAAAACC CAANGACACCCCTCNTGATC TCCCGGACCCCTGAGGTCN NATGCGTGGTGGTGNNGT GAGCCACGAAGACCCNGAN NCNAGTTCAACTGGNACGN GGACGGNGNNNNGGNGCA NNANGCCAAGACAAAGCCG CGGAGGANCNNT ANNAN N$_4$GC$_4$CNN$_4$CCGNNNNGNC AGCGNNCCNTNNNCGNCNG NNCCNNNNACTNNNNAANG GCNNNNTACANNNCNNGNN NTCCANNNANNNNNNNNNN NCNTNNNNAANCNNNNNNN NCAANNNNNNNNNNNCC CCCNNNNNNN (SEQ ID NO: 3609) | | | | | |
| V-CO55 | NNNNNNNNNNNNTGNNNN NTACANNNTACGATTTAGGT GACATCTATAGAATAACATC CACTTTGCCTTTCTCCAC NNGNGTCCACTCCCAGGTC CAACTGCACCTCGGTTCTAT CGATTGAATTCCACCATGG GATGTCATGTATCATCCTT TTTCTAGTAGCAACTGCAA CCGGTGTACATTCTGAGGT GCAGCTGGTGGAGTCTGGA GAGGCTTGATCCAGCCTG GGGGTCCCTGAGACTCTC | GAGGTGCAGCTGGTGGAGT CTGGAGGAGGCTTGATCCA GCCTGGGGGGTCCCTGAGA CTCTCCTGTGCAGCCTCTGG GTTCATCGTCAGTAGCAAC TACATGAGCTGGGTCCGCC AGGCTCCAGGGAAGGGCT GGAGTGGGTCTCAGTTATTT ATAGCGGTGTAGCACATT CTACGCAGACTCCGTGAAG GGCCGATTCACCATCTCCA GAGACAATTCCAAGAACAC GCTGTATCTTCAAATGAAC | COV047_P5_C3 | NNNNNNNNNNATGTATCN TACATACATACGATTTAGGT GACACTATAGAATAACA TCCACTTTGCCTTTCTCT CCACAGGTGTCCACTCCC AGGTCCAACTGCACCTC GGTTCTATCGATTGAATT CCACCATGGGATCGATCA TGTATCATCCTTTTTCTA GTAGCAACTGCAACCGG GTACATTCAGAAATAG TGTACATTGACGAGTCCA TGATGACGCAGTCTCCA GCCACCCTGTCTGTGTCT | GAAATAGTGATGACGCAGT CTCCAGCCACCCTGTCTGTG TCTTCCAGGGGAAAGAGCCA CCCTCTCCTGCAGGGCCAGT CAGAGTGTTAGCAGCAACTT AGCCTGGTACCAGCAGAAA CCTGGCCAGGCTCCCAGGCT CCTCATCTATGGTGCATCCA CCAGGGCCACTGTATCCA GCCAGGTTCAGTGGCAGTG GGTCTGGGACAGAGTTCACT CTCACCATCAGCAGCCTGCA GTCTGAAGATTTTGCAGTT | COV047_P5_C3 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CTGTGC TABLE 15-continued Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CNNCG TABLE 15-continued Additional sequence information for the disclosed anti-SARS-CoV-2 antibodies

| ALICE | AbsID | HEAVY CHAIN | | LIGHT CHAIN | | |

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C057 | NNNNNNNNTATGTATCNTA CACNTACGATTTAGGTGAC ACTATAGAATAACATCCAC TTTGCCTTTCTCCACAGG TGTCCACTCCCAGTCCAA CTGCACCTCGGTTCATCGA TTGAATTCCACCATGGGAT GGTCATGTATCATCCTTTTT CTAGTAGCAACTGCAACCG GTGTACATTCGACGTGCA GCTGTTGGAGTCTGGGGGA GGCTTGGTACAACCTGGGG GGTCCCCTGAGACTCTCCTGT GCAGCCTCTGGATTCACCTT TAGCAGCTATGCCATGAGC TGGGTCCGCCAGGCTCCAG GGAAGGGGCTGGAGTGGGT CTCAGCTACCAGTGATAGT GGTGTACCACCATACTACG CAGACTCCGTGAAGGGCCG GTTCACCATCTCCAGAGAC AATTCCAAGAACACGCTGT ATCTGCAAATGAATAGTCT GAGAGCCGAGGACACGGCC ATATATTACTGTGCGAGGA GAGAAATAGTGGGAGCTA CCCTGACCCTGACTACTGG GGCCAGGGAACCCTGGTCA CCGTCTCCTCAGCGTCGACC AAGGGCCCATCGGTCTTCC CCCTGGCACCCTCCTCCAA GAGCACCTCTGGGGCACA GCGGCCCTGGGCTGCCTGG TCAAGGACTACTTCCCCGA ACCTGTGACGGTCTCGTGG AACTCAGGCGCCCTGACCA GCGGCGTGCACACCTTCCC GGCTGTCCTACAGTCCTCA GGACTCTACTCCCTCAGCA GCGTGGTGACCGTGCCCTC CAGCAGCTTGGGCACCCAG ACCTACATCTGCAACGTGA ATCACAAGCCCAGCAACAC CAAGGTGGACAAGAGAGTT | GAGGTGCAGCTGTTGGAGT CTGGGGGAGGCTTGGTACA ACCTGGGGGGTCCCTGAGA CTCTCCTGTGCAGCCTCTGG ATTCACCTTTAGCAGCTATG CCATGAGCTGGGTCCGCCA GGCTCCAGGGAAGGGGCTG GAGTGGGTCTCAGCTACCA GTGATAGTGGTGTACCAC ATACTACGCAGACTCCGTG AAGGGCCGGTTCACCATCT CCAGAGACAATTCCAAGAA CACGCTGTATCTGCAAATG AATAGTCTGAGAGCCGAGG ACACGGCCATATATTACTGT GCGAGGAGAAATAGTGG GAGCTACCCTGACCCTG ACTACTGGGGCCAGGGAAC CCTGGTCACCNTCTCCTCAG (SEQ ID NO: 3622) | COV047_ P3_C5 | NNNNNNNCNTATGNATC NTACACATACGATTTAG GTGACACTATAGAATAA CATCCACTTTGCCTTTCT CTCCACAGTGTCCACTC CCAGTCCAACTGCACC TCGGTTCTATCGATTGAA TTCCACCATGGGATGGTC ATGTATCATCCTTTTTCT AGTAGCAACTGCAACCG GTGTACATTCGGACATC GTGATGACCCAGTCTCC AGACTCCCTGGCTGTGTC TCTGGGCGAGAGGGCCA CCATCAACTGCAAGTCC AGCCAGAATGTTTTATAC AGTCCAACAATAAGAA CTACTTAGCTTGGTACCA GCAGAAACCAAGACAGC CTCCTAAACTGCTCATTT ACTGGGCATCTACCCGG GAATCCGGGGTCCCTGA CCGATTCAGTGGCAGCG GGTCTGGGACAGATTTC ACTCTCACCATCAGCAG CCTGCAGGCCGAAGATG TGGCAGTTTATTACTGTC AGCAATATTATACTCTTC GTTGGACGTTCGGCCAA GGGACCAAGGTGGAAAT CAAACGTACGGTGGCTG CACCATCTGTCTTCATCT TCCCGCCATCTGATGAGC AGTTGAAATCTGGAACT GCCTCTGTTGTGTGCCTG CTGAATAACTTCTATCCC AGAGAGGCCAAAGTACA GTGGAAGGTGGATAACG CCCTCCAATCGGGTAACT CCCAGGAGAGTGTCACA GAGCAGGACAGCAAGGA GCACCTACAGCCTCA GCAGCACCCTGACCCTG AGCAAAGCAGACTACGA | GACATCGTGATGACCCAGTC TCCAGACTCCCTGGCTGTGT CNNTGGGCGAGAGGGCCAC CATCAACTGCAAGTCCAGCC AGAATGTTTTATACAGTCCC AACAATAAGAACTACTTAG CTTGGTACCAGCAGAAACC AAGACAGCCTCCTAAACTGC TCATTTACTGGGCATCTACC CGGGAATCCGGGGTCCCTG ACCGATTCAGTGCAGCCG GTCTGGGACAGATTTCACTC TCACCATCAGCAGCCTGCAG GCCGAAGATGTGGCAGTTTA TTACTGTCAGCAATATTATA CTCTTCGTTGGACGTTCGGC CAAGGGACCAAGGTGGAAA TCAAAC (SEQ ID NO: 3624) | COV047_ P3_C5 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | GAGCCCAAATCTTGTGACA AAACTTCACACATGCCCACC GTGCCCAGCACCTGAACTC CTGGGGGGACCGTCAGTCT TCCTCTTCCCCCAAAACCC ANNNCACCCTCATGATCTC CCGGACCCCTGAGGTCACA TGCGTGGTGGTGGAGGTGA GNCACGAGACCNNGAAGN NNNNNNAGNNNNGNTNNA GNTNGGNANNGNNANGGC NTNGNAGGTCATAATGNN NNNNAAANNCNNNGGGA NGANCAGTACAANNGCACN NACCNNNNNGGNNNNNNN NNNNNNCNGTNCNNNNNN NNN(SEQ ID NO: 3621) | | | GAAACACAAAGTCTACG CCTGCGAAGTCACCCAT CAGGGCCTAGCCTGCC CGTCACAAAGAGCTTCN ANNNGGGGAGAGTGTT AGAAGCTTGNCCGCCA TGGCCCAACTTGNTTNT TNGCAGNTNTATANNNN TNNCAAATAAAGCAATA GCATCACAAATTTCACA AATAAAGCATTTTTTCA CTGCATTCTAGTTGTGGT TTGTCCAAACTCATCAAN GNATNTNATCATGNCTG GNTCGNNATNATTCGNG CAGCNNCATNNNCTGAA TACNTCTGAANAGACTN NNNNACTNNGAGNGAAG ANNNCNNNGANGNGNN GTCNNTNNNNGGGGNA NNNNNNCCNNNNNC (SEQ ID NO: 3623) | | |
| V-C058 | NNNNNNNNNTGNNTCNT ACACNTACGATTTAGGTGA CACTATAGAATAACATCCA CTTTGCCTTTCTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACATTCCCAGGTGC AGCTGGTGCAGTCTGGGGC TGAGGTGAAGAAGCCTGGG GCCTCAGTGAAGGTTTCCT GCAAGGCATCTGGATACAC CTTCATCAGCTACTATATGC ACTGGGTGCGACAGGCCCC TGGACAAGGGCTTGAGTGG ATGGGAATAATCAACCTA GTGTGGTAGCACAAGGCTA CGCACAGAAGTTCAGGGC ACACTGTCCACAGAGCACGT | CAGGTGCAGCTGGTGCAGT CTGGGGCTGAGGTGAAGAA GCCTGGGGCCTCAGTGAAG GTTTCCTGCAAGGCATCTG GATACACCTTCATCAGCTA CTATATGCACTGGGTGCGA CAGGCCCCTGGACAAGGGC TTGAGTGGATGGGAATAAT CAACCCTAGTGGTGGTAGC ACAAGCTACCCACAGAAGT TCCAGGGCAGAGTCACCAT GACCAGGGACACGTCCACG AGCACAGTCTACATGGAGC TGAGCAGCCTGAGATCTGA GGACACGGCCGTGTATTAC TGTGCTAGGGCAAATGAGG GAGCAGCTGTTTCATTTGAC TACTGGGCCAGGGACCCC TGGTCACCNTNTCCTCAG (SEQ ID NO: 3626) | COV047_P5_F6 | NNNNNNNNNNNNNTGT NTNNACNCNTACGATTTT AGGTGACACTATAGAAT AACATCCACTTTGCCTTT CTCTCCACAGGTGTCCAC TCCCAGGTCCAACTGCA CCTCGGTTCTATCGATTG AATTCCACCATGGGATG GTCATGTATCATCCTTTT TCTAGTAGCAACTGCAA CCGGTGTACATTCCCAGG TCCAGATGACCCAGTCTC CATCCTCCCTGTCTGCAT CTGTAGGAGACAGAGTC ACCATCACTTGCCGGGC AAGTCAGAGCATTAGCA GCTATTTAAATTGGTATC AGCAGAAACCAGGGAAA GCCCCTAAGCTCCTGATC TATGCTGCATCCAGTTTG CAAAGTGGGGTCCCATC AAGGTTCAGTGGCAGTG | GACATCCAGATGACCCAGTC TCCATCCTCCCTGTCTGCAT CTGTAGGAGACAGAGTCAC CATCACTTGCCGGGCAAGTC AGAGCATTAGCAGCTATTTA AATTGGTATCAGCAGAAAC CAGGGAAAGCCCCTAAGCT CCTGATCTATGCTGCATCCA GTTTGCAAAGTGGGGTCCCA TCAAGGTTCAGTGGCAGTGG ATCTGGGACAGATTTCACTC CTGAAGATTTTGCAACTTA CTACTGTCAACAGAGTTACA GTACCCCTCCGAGGGACCAAGGT TTTGGCCAGGGGACCAAGCT GGAGATCAAAC (SEQ ID NO: 3628) | COV047_P5_F6 |

TABLE 15-continued

Additional sequence information for the disclosed anti-SARS-CoV-2 antibodies

| | | HEAVY CHAIN | | LIGHT CHAIN | |
|---|---|---|---|---|---|
| ALICE | AbsID | miniprep sequence | original nt sequence | sequence ID (plate/well) | miniprep sequence | original nt sequence | sequence ID (plate/well) |
| | | CTACATGGAGCTGAGCAGC CTGAGATCTGAGGACACGG CCGTGTATTACTGTGCTAGG GCAAATGAGGGAGCAGCTG TTTCATTTGACTACTGGGGC CAGGGAACCCTGGTCACCG TCTCCTCAGCGTCGACCAA GGGCCCATCCGTCTTCCCC TGGCACCCTCCTCCAAGAG CACCCTCGGGGGCACAGCG GCCCTGGGCTGCCTGGTCA AGGACTACTTCCCCGAACC TGTGACGGTCTCGTGGAAC TCAGGCGCCCTGACCAGCG GCGTGCACACCTTCCCGGC TGTCCTACAGTCCTCAGGA CTCTACTCCCTCAGCAGCGT GGTGACCGTGCCCTCCAGC AGCTTGGGCACCCAGACCT ACATCTGCAACGTGAATCA CAAGCCCAGCAACACCAAN GTGGACAAGAGAGTTGAGC CCAAATCTTGTGACAAAAC TCACACATGCCACCGTGC CCAGCACCTGAACTCCTGG GGGGGANCGTCAGTCTTNN TCTTNNNNNCNNAANANAA NGNANANGNNCNNNNNNNN NNNNNTNCCCGNNNNNNNNG NNGNNNCNTGGGGTGGNNG GTGNNNNNGANCNNNNAA NANCCNNGANGTCAAGTTC AACTGGNACNGTNGNNGGG CGTNNNNGCANNANGNCAA NANNAGCCNNNGGANGNN CANTANANAGCNCGTACCG NGNNNGNCAGCGTCCTNNN NNCNGCNCANNACNGGNTG AANGNANGNANTNNNA NNNNNN (SEQ ID NO: 3625) | | | GATCTGGGACAGATTTC ACTCTCACCATCAGCAGT CTGCAACCTGAAGATTTT GCAACTTACTACTGTCAA CAGAGTTACAGTACCCC TCCGGAGGGCAGTTTTG GCCAGGGACCAAGCTG GAGATCAAACGTACGGT GGCTGCACCATCTGTCTT CATCTTCCCGCCATCTGA TGAGCAGTTGAAATCTG GAACTGCCTCTGTTGTGT GCCTGCTGAATAACTTCT ATCCCAGAGAGGCCAAA GTACAGTGGAAGGTGGA TAACGCCCTCCAATCGG GTAACTCCCAGGAGAGT GTCACAGAGCAGGACAG CAAGGACAGCACCTACA GCCTCAGCAGCACCCTG ACGCTGAGCAAAGCAGA CTACGAGAAACACAAAG TCTACGCCTGCGAAGTC ACCCATCANGGCCTGAG CTCGCCCGTCACAAAGA GCTTCAACAGGGGAGAG TGTTAGAAGCTTGGCCG NCCATGNCCCAACTTGTT TATTGCAGCTTATAATGG TTACAAATAAAGCAATA GCATCACAAATTTCACA AATAAAGCATTTTTTTCA CTGCATTCTAGTTGTGGT TTGTCCAAACTCATCAAT GTATCTNATCATGTCTGG NTCGGGAATTNATTCGN CGCAGCANCATGNNNNA ANNACTNNGANNNANNN NNNNNNNNNNNNNN NNNNTGAGCGAAAGAAC ATCTGNNGANTNNGNGT CANTTNNNNNGN (SEQ ID NO: 3627) | | |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| V-CO59 | NNNNNNNNNANGNNTC NTACACATACGATTTAGGT GACACTATAGAATAACATC CACTTTGCCTTTCTCTCCAC AGGTGTCCACTCCCAGGTC CAACTGCACCTGGGTCTAT CGATTGAATTCCACCATGG GATGGTCATGTATCATCCTT TTTCTAGTAGCAACTGCAA CCGGTGTACATTCTGAGGT GCAGCTGGTGGAGTCTGGG GGAGACTTGGTCCAGCCTG GGGGGTCCCTGAGACTCTC CTGTTCAGCCTCTGATTCA CCTTCAGTAGCTATGCTATG CACTGGGTCCGCCAGGCTC CAGGGAAGGGACTGAATA TGTTTCAGTTATTAGTAATA CTGGGGGTGACACATATCA CGCAGACTCCGTGAAGGGC AGATTCACCATCTCCAGAG ACAATTCCAAGAACACGTT GTATCTTCAAGTGAGCAGT CTGAGACCTGAAGACACGG CTGTGTATTACTGTGTGAAA GATCAAGGGGGCCGGGGGT GGCCAAGTTACTACTACTA CCACTACATGGACGTCTGG GGCAAAGGGACCACGGTCA CCGTCTCCTCAGCGTCGACC AAGGGCCCATCGGTCTTCC CCCTGGCACCCTCCTCCAA GAGCACCTCTGGGGGCACA GCGGCCCTGGGCTGCCTGG TCAAGGACTACTTCCCCGA ACCTGTGACGGTGTCGTGG AACTCAGGCGCCCTGACCA GCGGCGTGCACACCTTCCC GGCTGTCCTACAGTCCTCA GGACTCTACTCCCTCAGCA GCGTGGTGACCGTGCCCTC AAGGGCCCATCGGTCTTCC ATCAAGGCCCAGCCAACAC | GAGGTGCAGCTGGTGGAGT CTGGGGGAGACTTGGTCCA GCCTGGGGGGTCCCTGAGA CTCTCCTGTTCAGCCTCTGG ATTCACCTTCAGTAGCTATG CTATGCACTGGGTCCGCCA GGCTCCAGGGAAGGGACTG GAATATGTTTCAGTTATTAG TAATACTGGGGGTGACACA TACTACGCAGACTCCGTGA AGGGCAGATTCACCATCTC CAGAGACAATTCCAAGAAC ACGTTGTATCTTCAAGTGA GCAGTCTGAGACCTGAAGA CACGGCTGTGTATTACTGTG TGAAAGATCAAGGGGGCCG GGGGTGGCCAAGTTACTAC TACTACCACTACATGGACG TCTGGGGCAAAGGGACCAC GGTCACCGTCTCCTCA (SEQ ID NO: 3630) | COV047_P5_G9 | NNNNNNNNTTATGTATN NNCNCATACGATTTAGG TGACACTATAGAATAAC ATCCACTTTGCCTTTCTC TCCACAGGTGTCCACTCC CAGGTCCAACTGCACCT CGGTTCTATCGATTGAAT TCCACCATGGGATGGTC ATGTATCATCCTTTTTCT AGTAGCAACTGCAACGG GTTCCTGGGCCCAGTCTG CCGTGTCTGGGTCTCCTG GACGACTCAACCATC TCCTGCACTGGAACCAG CAGTGACATTGGTGATT ATAACTATGTCTCCTGGT ACCAACCACCCCAGGC AAAGCCCCAAACTCAT GATTTATGAAGTCAGTA ATCGGCCCTCAGGGGTTT CTAATCGCTTCTCTGGCT CCAAGTCTGCAACACG GCTCCCTGACCATCTCT GGGCTCCAGGCTGAGGA CGAGACTGATTATTACTG CATCTCATATACAAGCA GCAGCACTCTTCCCTATG TCTTCGGAACTGGGACC AAGGTCACCGTCCTAGG TCAGCCCAAGGCCAACC CCACTGTCACTCTGTTCC CACCCTGAGTGAGGAG CTTCAAGCCAACAAGGC CACACTGGTGTGTCTCAT AAGTGACTTCTACCCGG GAGCCGTGACAGTGGCC TGGAAGGCAGATAGCAG CCCCGTCAAGGCGGGAG TGGAGACCACCACACCC TCCAAACAAAGCAACAA CAAGTACGCGGCCAGCA GCTACCTGAGCCTGACG CCTGAGCCAGTGGAAGTC | CAGTCTGCCCTGACTCAGCC TGCCTCCGTGTCTGGGTCTC CTGGACAGTCGATCACCATC TCCTGCACTGGAACCAGCAG TGACATTGGTGATTATAACT ATGTCTCCTGGTACCAACAC CACCCAGGCAAAGCCCCCA AACTCATGATTTATGAAGTC AGTAATCGGCCCTCAGGGGT TTCTAATCGCTTCTCTGGCT CCAAGTCTGGCAACACGGC CTCCCTGACCATCTCTGGGC TCCAGGCTGAGGACGAGAC TGATTATTACTGCATCTCAT ATACAAGCAGCACTCTT CCCTATGTCTTCGGAACTGG GACCAAGGTCACCGTCCTAG (SEQ ID NO: 3632) | COV047_P5_G9 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | CAAGTGGACAAGAGAGTT GAGCCCAAATCTTGTGACA AAACTCACACATGCCCACC GTGCCCAGCACCTGAACTC CTGGGGGACCGTCAGTCT TCCTCTTCCCCCAAAACCC AAGGACACCCTCATGATCT CCCGACCCCTGAGGTCAC ATGCGTGGGNGGNGGANNT GANCCACNANACCCTGAGN CAAGTTCAACTGGNACNNG GNNGGCGNNGAGGTCCATA ATGNNAANAANNAANNCG CGGGAGGANCAGTACNANN NGCNNNTACCGNNNGGNNA GNCNNNNNNNNNCNNNN NNNNNANTGNNNNNAANGG NN (SEQ ID NO: 3629) | | | | | |
| V-C060 | NNNNNNCNNATGTTATCNT ACNCATACGATTTAGGTGA CACTATAGAATAACATCCA CTTTGCCTTTCTCTCCACAG GTGTCCACTCCCAGTCCA ACTGCACCTCGGTTCTATCG GTATCAGCTGGGTGCGACA GGCCCCTGGACAAGGGCTT GAGTGGATGGGATGGATCA GCGCTTACAACTGCAAACC TCTAGTAGCAACTCCAGTTC GGCTGTACATTCCCAGGTTC AGCTGCGCAGTCTGGAGC TGAGGTGAAGAAGCCTGGG GCCTCAGTGAAGGTCCCCT CAAGGCTTCTGGTTACAC CTTTACCAGCTACGTATCA GCTGGGTGCGACAGGCCC TGGACAAGGGCTTGAGTGG ATGGGATGGATCAGCGCTT ACAATGGTAACAAACTA TGCAGAAGGCTTCCAGGGC | CAGGTTCAGCTGGTGCAGT CTGGAGCTGAGGTGAAGAA GCCTGGGGCCTCAGTGAAG GTCTCCTGCAAGGCTTCTGG TTACACCTTTACCAGCTACG TATCAGCTGGGTGCGACA GGCCCCTGGACAAGGGCTT GAGTGGATGGGATGGATCA GCGCTTACAATGGTAACAC AAACTATGCACAGAAGCTC CAGGGCAGAGTCACCATGA CCACAGACACATCCACGAG CACAGCCTACATGGAGCTG AGGAGCCTGAGATCTGACG ACACGGCCGTGTATTACTG TGCGAGAGTTCCCGCTCG TACGGTGACGACGATTACT ACTACTACTACGGTATGGA CGTCTGGGGCCAAGGGACC ACGGTCACCGTCTCCTCA | COV107_P3_E5 | NNNNNNTATGTATCNT ACACNTACGATTTAGGT GACACTATAGAATAACA TCCACTTTGCCTTTCTCT CCAGGTGTCCACTCCCC AGGTCCAACTGCACCTC GGTTCTATCGGTATCGAATT CCACCATGGGATGGTCA TGTATCATCCTTTTCTA GTAGCAACTCCAACGG TTCTGCACCTCCTATGA GCTGACACAGCCACCCT CGGTGTCAGTGTCCCCA GGACAGACGGCCAGGAT CACCTGCTCTGGAGATG CATTGCCAAAGCAATAT GCTTATTGGTACCAGCA GAAGCCAGGCCAGCCC CTGTGCTGGTGATATATA AAGACAGTGAAGAGCCC | TCCTATATGTGCTGACTCAGCC ACCCTCCGTGTCCAGTGTCCC CAGGACAGACGGCCAGGAT CACCTGCTCTGGAGATGCAT TGCCAAAGCAATATGCTTAT TGGTACCAGCAGAAGCCAG GCCAGGCCCCTGTGCTGTG ATATATAAAGACAGTGAGA GGCCCTCCAGGATCCCTGAG CGATTCTCTGGCTCCAGCTC AGGGACAACAGTCACGTTG ACCATCAGTGGAGCTCCAGG CAGAAGACGAGCTGACTA TTACTGTCAATCAGCAGACA GCATTCTCACTCTTTGGGTG TTCGGCGGAGGGACCAAGC TGACCGTCCTAG (SEQ ID NO: 3636) | COV107_P3_E5 |
| | | | | miniprep sequence NNNNNNTATGTATCNT ACACNTACGATTTAGGT ... NTNNNNNAANNNNNN (SEQ ID NO: 3631) | | |

TABLE 15-continued

Additional sequence information for the disclosed anti-SARS-CoV-2 antibodies

| | | HEAVY CHAIN | | LIGHT CHAIN | |
|---|---|---|---|---|---|
| ALICE | AbsID | miniprep sequence | original nt sequence | sequence ID (plate/well) | miniprep sequence | original nt sequence | sequence ID (plate/well) |
| | | AGAGTCACCATGACCACAG<br>ACACATCCACGAGCACAGC<br>CTACATGGAGCTGAGAGC<br>CTGAGATCTGACGACACGG<br>CCGTGTATTACTGTGCGAG<br>AGTTCCCGCCTCGTACGGT<br>GACGAGCGATTACTACTACT<br>ACTACGGTATGGACGTCTG<br>GGGCCAAGGGACCACGGTC<br>ACCGTCTCCTCAGCCGTCGA<br>CCAAGGGCCCATCGGTCTT<br>CCCCCTGGCACCCCTCCTCCA<br>AGAGCACCTCTGGGGCAC<br>AGCGGCCCCTGGGCTGCCTG<br>GTCAAGGACTACTTCCCCG<br>AACCTGTGACGGTCTCGTG<br>GAACTCAGGCGCCCTGACC<br>AGCGGCGTGCACACCTTCC<br>CGGCTGTCCTACAGTCCTCA<br>GGACTCTACTCCCTCAGCA<br>GCGTGGTGACCGTGCCCTC<br>CAGCAGCTTGGGCACCCAG<br>ACCTACATCTGCAACGTGA<br>ATCACAAGCCCAGCAACAC<br>CNANGTGGACAAGAGAGTT<br>GAGCCCAAATCTTGTGACA<br>AAACTCACACATGCCCACC<br>GTGCCCAGCACCTGAACTC<br>CTGGGGGACCGTCAGTCT<br>TCCTCTTCCCCCCAAAACC<br>AAGGNNNCCCTCATGATNN<br>NCCCGNACCCNGAGGTCA<br>CATGCCGTGGNGGTGGACGT<br>GANCCACGAANACCCTGAG<br>NCAAGTTCAACTGGNACNN<br>GGNNGGCNNNNNNGCATA<br>ANGNNANAANNAAGCCGN<br>NGGNAGGANCANNNNNNN<br>NAGCNCNGNNCCGNGNNNN<br>NCANNNTTCNNN (SEQ<br>ID NO: 3633) | (SEQ ID NO: 339) | | TCAGGGATCCCTGAGCG<br>ATTCTCTGGCTCCAGCTC<br>AGGGACAACAGTCACGT<br>TGACCATCAGTGAGTC<br>CAGGCAGAGACGAGGC<br>TGACTATTACTGTCAATC<br>AGCAGACAGCAGTGTA<br>CTCTTTGGGTGTTCGGCG<br>GAGGGACCAAGCTGACC<br>GTCCTAGGTCAGCCCAA<br>GGCTGCCCCCTCGGTCAC<br>TCTGTTCCCACCCTCGAG<br>TGAGGAGCTTCAAGCCA<br>ACAAGGCCACACTGTG<br>TGTCTCATAAGTGACTTC<br>TACCCGGGAGCCGTGAC<br>AGTGGCCTGGAAGGCAG<br>ATAGCAGCCCCGTCAAG<br>GCGGGAGTGGAGACCAC<br>CACACCCTCCAAACAA<br>GCAACACAAGTACGCG<br>CCTGAGCAGCTACCTGAG<br>CCTGAGCGCCTGAGCAGT<br>GGAAGTCCCACAGAAGC<br>TACAGCTGCCAGTCAC<br>GCATGAAGGGAGCACCG<br>TGGAGAAGACAGTGCCC<br>CCNANNNNNAATGTTCA<br>TAGAAGCTTGGCCCCGCC<br>ATGGCCCAACTTGTTTAT<br>TGCAGCTTATAATGGTTA<br>CAAATAAAGCAATAGCA<br>TCACAAATTTCACAAAT<br>AAGCATTTTTTCACTG<br>CATTCTAGTTGTGGTTTG<br>TCCAAACTCATCAATGN<br>NTCTTATCATGTCTGNT<br>CGGNATTNATTNGNN<br>GCAGCNNNTGNNNGAAN<br>NANNNTGAAAGAGNNTN<br>NNNNGNNCTTCTGAGNG<br>AANACNTCNNNNGANNN<br>NNGTCANTNNNNNGAAN<br>GTCCCAGNTCCCNNNNG<br>GNNNTNGNNNNNNNN | | |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| V-C061 | NNNNNNNCNNATGTATCN TACNCNTACGATTTAGGTG ACACTATAGAATACATCC ACTTTGCCTTTCTCTCCACA GGTGTCCACTCCCAGGTCC AACTGCACCTCGGTTCTATC GATTGAATTCCACCATGGG ATGGTCATGTATCATCCTTT TTCTAGTAGCAACTGCAAC CGGTGTACATTCCCAGGTG CAGCTACAGCAGTGGGGCG CAGGACTGTTGAAGCCTTC GGAGACCCTGTCTCTCACCT GCGCTGTCTCTGGTGGGTC ACTCAGTGGTTTCTACTGGA CCTGATCCGCCAGCCCCC CGGAAAGGGGCTGGAGTGG ATTGGGAAACCAATCATT TGGAAGCACCGACTACAA GCCGTCCCTCAAGAGTCGA GTCACCATATCAGTAGACA TGTCCAGGAACCAATTTTCC CTGATTATGACCTCTGTGAC CGCCCGGACACGGCTGTG TATTACTGTGCGAGAAAGA CCCTCCTCTTCAGTGACTTT TCTCCTGGTCTTTTGATAT CTGGGGCCAAGGGACAATG GTCACCGTCTCTTCAGCGTC GACCAAGGGCCCATCGGTC TTCCCCCTGGCACCCTCTC CAAGAGCACCTCTGGGGC ACAGGCGGCCCTGGGCTGCC TGGTCAAGGACTACTTCCC CGAACCTGTGACGGTCTCG TGGAACTCAGGCGCCCTGA CCAGCGGCGTGCACACCTT CCCGGCTGTCCTACAGTCCT CAGGACTCTACTCCCTCAG CAGGCGTGTGACCGTGCCC TCCAGCAGCTTGGGCACCC | CAGGTGCAGCTACAGCAGT GGGGCGCAGGACCCTGTTGAA GCCTTCGGAGACCCTGTCTC TCACCTGCGCTGTCTCTGGT GGGTCACTCAGTGGTTTCTA CTGGACCTGATCCGCCAG CCCCCCGGAAAGGGCTGG AGTGGATTGGGAAACCAA TCATTTGGAAGCACTGCAAC TACAAGCCGTCCCTCAAGA GTCGAGTCACCATATCAGT AGACATGTCCAGGAACCAA TTTTCCCTGATTATGACCTC TGTGACCGCCCGGACACG GCTGTGTATTACTGTGCGA GAAAGACCCTCCTCTTCAG TGACTTTTCTCCTGGTCTT TTGATATCTGGGGCCAAGG GACAATGGTCTAGTCTCTT CAG (SEQ ID NO: 3638) | COV107_ P1_G12 | NNNTNNNCANTNNNTCA NNNNNN (SEQ ID NO: 3635) NNNNNNNNNNTATGNN TCNTACNCATACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCCTTTTT CTAGTAGCAACTGCAAC CGGTGTACATTCCAGAA TTGTGTTGACGCAGTCT CAGGGCACCCTGTCTTTGT CTCCAGGGGAAAGAGCC ACCCTCTCCTGCAGGGCC AGTCAGACTCTTACCGCC AACTACTTAGCCTGGTAC CAGCAGAAACCTGGCCA GGCTCCCAGACTCCTCAT CTATGGTGCATCCAAGA GGGCCACTGGCATCCCA GACAGGTTCAGTGGCAG TGGTCTGGGACAGACT TCACTCTCAGCATCAGCA GACTGGAGCCTGAAGAT TTTGCAGTGTATTACTGT CAGCAGTATGGTACTAC ACCTGGACTTTCGCGG GAGGGACCAAGGTGGAA ATCAAACGTACGGTGGC TGCACCATCTGTCTTCAT CTTCCCGCCATCTGATGA GCAGTTGAAATCTGGAA CTGCCTCTGTTGTGTGCC TGAATAACTTCTATC CCAGAGAGGCCAAAGTA CAGTGGAAGGTGGATAA CGCCCTCCAATCGGGTA ACTCCAGGAGAGTGTC ACAGAGCAGGACAGCAA GGACAGCACCTACAGCC | GAAATTGTGTTGACGCAGTC TCCAGGCACCCTGTCTTTGT CTCCAGGGGAAAGAGCCAC CCTCTCCTGCAGGGCCAGTC AGACTCTTACCGCCAACTAC TTAGCCTGGTACCAGCAGAA ACCTGGCCAGGCTCCCAGAC TCCTCATCTATGGTGCATCC AAGAGGGCCACTGGCATCC CAGACAGGTTCAGTGGCAG TGGGTCTGGGACAGACTTCA CTCTCAGCATCAGCAGACTG GAGCCTGAAGATTTTGCAGT GTATTACTGTCAGCAGTATG GTACTACACCTCCGGACTTTC GGCGGAGGGACCAAGGTGG AGATCAA (SEQ ID NO: 3640) | COV107_ P1_G12 |

TABLE 15-continued

Additional sequence information for the disclosed anti-SARS-CoV-2 antibodies

| ALICE AbsID | HEAVY CHAIN | | | LIGHT CHAIN | | |
|---|---|---|---|---|---|---|
| | miniprep sequence | original nt sequence | sequence ID (plate/well) | miniprep sequence | original nt sequence | sequence ID (plate/well) |
| | AGACCTACATCTGCAACGT GAATCACAAGCCCAGCAAC ACCAGGTGACAAGAGAG TTGAGCCCAAATCTTGTGA CAAAACTCACACATGCCCA CCGTGCCCAGCACCTGAAC TCCTGGGGGACCGTCAGT CTTCCTCTTCCCCCCAAAAC CCAAGGACACCCCTCATGAT NNNCCGGACCCCTGANGTC NNNTGCNTGGTGGTGGACG TGAGCCACGANNACCCTGN NNCAGTCANTGGNACGNNG NNGGNNNGNAGGTNCATAA TGNCAANANNAAGCCNNNG GNAGGAGCAGNNNNNANCA GCNNNCGTACCNNNNNNNN ANCNNN (SEQ ID NO: 3637) | | | TCAGCAGCACCCTGACG CTGAGCAAAGCAGACTA CAGAGAAACACAAAGTCT ACGCCTGCGAAGTCACC CATCAGGGCCTGAGCTC GCCCGTCACAAAGAGCT TCAACAGGGAGANANNNN NGAAGCTTNGGCCNCCN TGNGCCNCNNNNTGTN TNNNNNNNTNNNNNNN NTNACAAATAAAGCAAT ANCATCNCANNTTCNCA AAAAANNNNTTTTTTNT CACTGCATNNNGTGNGN TTGTCCAACTCATCATGN NNCTNNCATGNCNGNTC GGNNTNNNGNGCANCAC NTNNNNANNNNNNGNA NNGANTGNNNGTACTNN NNNGNAANACNTCNGN GANGNNNCAGTNGGNG NNGANGTCCCNGNNNN (SEQ ID NO: 3639) | | |
| V-C062 | NNNNNNNNNATGNATCNTA CACATACGATTTAGGTGAC ACTATAGAATAACATCCAC TTTGCCTTTCTCTCCACAGG TGTCCACTCCCAGTCCAA CTGACCTCGGTTCTATCGA TTGAATTCCACCATGGGAT GGTCATGTATCATCTTTTT CTAGTAGCAACTGCAACCG GTGTACATTCCCAGGTGCA GCTCAGCAGTGGGGCGCA GGACTGTGAAGCCTTCGG AGACCCTGTCCCTCACCTGC GCTGTCTCTGGTGGGTCACT CAGTTGGTTTCTACTGTGCG GATCCGCAGCCCCCAGG AAAGGGGCTGGAGTGATT GGGAAACAATCATTTTG GAAGCACCGACTACAAGC GTCCCTCAAGAGTCGAGTC ACCATATCAGTAGGCATGT | CAGGTGCAGCTACAGCAGT GGGGCGCAGGACTGTTGAA GCCTTCGGAGACCCTGTCC CTCACCTGCGCTGTCTCTGG TGGGTCACTTCAGTGGTTTCT ACTGACCTGGATCCGCCA GCCCCCAGGAAAGGGGCTG GAGTGGATTGGGAAACCA ATCATTTTGAAGCACCGA CTACAAGGCGTCCCTCAAG AGTCAGTCACCATATCAG TAGGCATGTCCAGGAACCA ATTTCCCTGAAGGTGACTT CTCTGACCGCCGCGACAC GCTGTGTATTACTGTGCG AGAAAGCCCCTCTCTACA GTGACTTTTCTTCTGTGCT TTTGATATCTGGGGCCAAG GACAATGATCGTAGTCTC TTCAG (SEQ ID NO: 3642) | COV107_P1_A11 | NNNNNNNNNNNNATGNA TNNNCACNTACGATTTA GGTGACACTATAGAATA ACATCCACTTTGCCTTTC TCTCCACAGGTGTCCACT CCCAGGTCCAACTGCAC CTCGGTTCTATCGATTGA ATTCCACCATGGGATGG TCATGTATCATCTTTTT CTAGTAGCAACTGCAAC CGGTGTACATTCCAGAAA CCGGCCATCACCAGACTG TTGTTGACGCAGTCTC CAGGCACCCTGTCTTTGT CTCCAGGGAAAGAGCC ACCCTCTCCTGCAGGGCC AGTCAGAGTCTTACCGCC AACTACTTAGCCTGTAC CAGCAGAAACCTGGCCA GGCTCCCAGATCCCTCAT CTATGGTGCATCCAAGA GGGCCGCTGCATCCCA | GAAATTGTGTTGACGCAGTC TCCAGGCACCCTGTCTTTGT CTCCAGGGAAAGAGCCAC CCTCTCCTGCAGGGCCAGTC AGACTCTTACCGCCAACTAC TTAGCCTGGTACCAGCAGAA ACCTGGCCAGGCTCCCAGAC TCCTCATCTATGGTGCATCC AAGAGGGCCGCTGCATCC CAGACAGGTTCAGTGCAG TGGGTCTGGGACAGACTTCA CTCTCAGCATCACCAGACTG GAGCCTGAAGATTTTGCAGT GTATTACTGTCAGCAGTATC ATACTACACCTCGGACTTTC GCCGAGGGACCAAGGTGG AGATCAA (SEQ ID NO: 344) | COV107_P1_A11 |

TABLE 15-continued

Additional sequence information for the disclosed anti-SARS-CoV-2 antibodies

| | | HEAVY CHAIN | | | LIGHT CHAIN | |
|---|---|---|

TABLE 15-continued

Additional sequence information for the disclosed anti-SARS-CoV-2 antibodies

| ALICE | AbsID | HEAVY CHAIN | | | LIGHT CHAIN | | |
|---|---|---|---|---|---|---|---|
| | | miniprep sequence | original nt sequence | sequence ID (plate/well) | miniprep sequence | original nt sequence | sequence ID (plate/well) |
| | V-C063 | NNNNNNNNTNTGNATCNTA CACATACGATTTAGTGAC ACTATAGAATAAACATCAC TTTGCCTTTCTCTCCACAGG TGTCCACTCCCAGGTCCAA CTGCACCTCGGTTCTATCGA TTGAATTCCACCATGGGAT GGTCATGTATCATCCTTTTT CTAGTAGCAACTGCAACCG GTGTACATTCCCAGGTGCA GCTACAGCAGTGGGGCGCA GGACTGTTGAAGCCTTCGG AGACCCTGTCCTCCACCTGC GCTGTTCTGGTGGGTCACT CAGTGGTTTCTACTGTGCGA GGATCCGCCAGCCCCCAGG AAAGGGCTGGAGTGGATT GGGAAACCAATCATTTTG GAAGCACCGACTACAAGCC GTCCCTCAAGAGTCGAGTC ACCATATCAGTAGACATGT CCAGAACCAGTTCTCCCT GAAGTGACCTCTGTGACC GCCCGGACACGGCTGTTT ATTACTGTGCGAGAAAGCC CCTCCTCCACAGTGACTTAT CTCCTGGTGCTTTTTGATATC TGGGCCAAGGGACAATGG TCACCGTCTCTTCAGCGTCG ACCAAGGGCCCATCGGTCT TCCCCCTGGCACCCTCCTCC AAGAGCACCTCTGGGGCA CAGCGGCCCTGGGCTGCCT GGTCAAGGACTACTTCCCC GAACCTGTGACGGTCGT GGAACTCAGGCGCCCTGAC CAGCGGCGTGCACACCTTC CCGGCTGTCCTACAGTCCTC AGGACTCTACTCCCTCAGC AGCGTGGTGACCGTGCCCT CCAGCAGCTTGGGCACCCA GACCTACATCTGCAACGTG AATCAAGGCCCAGCAACA CCAANGTGNACAAGAGAGT TGAGCCCNNATCTTGTGAC | CAGGTGCAGCTACAAGCAGT GGGGCGCCAGGACTGTTGAA GCCTTCGGAGACCCTGTCC CTCACCTGCGCTGTCTCTGG TGGGTCACTCAGTGGTTTCT ACTGACCTGGATCCGCCA GCCCCCAGGAAAGGGCTG GAGTGGATTGGGAAACCA ATCATTTTGAAGCACCGA CTAGCAACTGCCAAGCGA AGTCAGTCACCATATCAG TAGACATGTCCAGGAACCA GTTCTCCCTGAAGGTGACCT CTGTGACCGCCGCGGACACC CAGTGGTTTCTACTGTGCGA GAAAGCCCAGCCCCCACAGG TGACTTATCTCCTGGTGCTT TTGATATCTGGGGCCAAGG GACAATGGTCGCCGTCTCTT CAG (SEQ ID NO: 3646) | COV107_ P2_C7 | NNNNNNNNTATGNATC NTACACATACGATTTAG GTGACATAGAATAA CATCCACTTTGCCTTTCT CTCCACAGGTGTCCACTC CCAGGTCCAACTGCACC TCGGTTCTATCGATTGAA TTCCACCATGGGATGGTC ATGTATCATCCTTTTTCT AGTAGCAACTGCAACCG GTGTACATTCCCAGGTGCA GTGTTGACGCAGTCTCCA GGCACCCTGTCTTTGTCT CCAGGGGAAAGAGCCAC CCTCTCCTGCAGGGCCA GTCAGACTGTTCCGCCA ACTACTTAGCCTGTACC AGCAGAAAGCTGGCCAG GCTCCCAGACTCCTCATC TATGTGCATCCAAGAG GGCCACTGGCATCCCAG ACAGGTTCAGTGGCAGT GGGTCTGGGACAGACTT CACTCTCAGCATCAGCA GACTGGAGCCTGAAGAT TTTGCTGTGTATTACTGT CAGCAGTATGTTACTAC ACCTCGGACTTTCGGCG GAGGGACCAAGGTGGAA ATCAAACGTACGGTGGC TGCACCATCTGTCTTCAT CTTCCCGCCATCTGATGA GCAGTTGAAATCTGGAA CTGCCTCTGTTGTGTGCC TGCTGAATAACTTCTATC CCAGAGAGGCCAAAGTA CAGTGGAAGGTGGATAA CGCCCTCCAATCGGGTA ACTCCCAGGAGAGTGTC ACAGAGCAGGACAGCAA GGACAGCACCTACAGCC TCAGCAGCACCCTGACG CTGAGCAAAGCAGACTA CGAGAAACACAAAGTCT ACGCCTGCGAAGTCACC | GAAATTGTGTTGACGCAGTC TCCAGGCACCCTGTCTTTGT CTCCAGGGGAAAGAGCCAC CCTCTCCTGCAGGGCCAGTC AGACTGTTTCCGCCAACTAC TTAGCCTGGTACCAGCAGAA AGCTGGCCAGGCTCCCAGA CTCCTCATCTATGTGCATC CAAGAGGGCCACTGGCATC CAGAGACAGGTTCAGTGCA GTGGGTCTGGGACAGACTTC ACTCTCAGCATCAGCAGACT GGAGCCTGAAGATTTTGCTG TGTATTACTGTCAGCAGTAT GTTACTACACCTCGGACTTT CGGCGGAGGGACCAAGGTG GAGATCAA (SEQ ID NO: 3648) | COV107_ P2_C7 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | ANAACTCACACATGCNCNC CGTGCNCNNCACCTGANNN CCNNNGGGGANNNNNCA NNGTTCTTCTTCCTCCTCCC CCCAAAANCNNANGACAN CCTCATGATCTCCCNGACCC CTGAGGTCACATGCGTGGT GGNGGACGTGAGCNACGAN GACCCNGNNNCAANTTCAN TGGNACNNNGNCGGCGTGN AGNTGCANANGNNANANAN AANNCNNNGGGNANNANC ANTANACAGCNCGNNNCNN NNNNGGNNNNNNCNTNN NCNNNCNNCNNNNNNGNA NTNNNNNGNAATGNNNNN NNANNNN (SEQ ID NO: 3645) | | | CATCAGGGCCTGAGCTC GCCCGTCACAAAGAGCT TCAACAGGGAGAGTGT TAGAAGCTTGGCCGCCA TGGCCCAACTTGTTATT GCAGCTTATAATGGTTAC AAATAAAGCAATAGCAT CACAAATTTCACAAATA AAGCATTTTTTCACTGC ATTCTAGTTGTGGTTTGT CCAAACTCATCAATGTAT CTTATCATGTCTGGNTCG GGAATTAATTCGGCGCA GCNCNTGNNNTGNAATA NNNTGAAAGANNANNNN NNNNANNNTGAGNGAAN ACNTCTNNGANNNNNGT CANTNGGNNGNNNNNGTC CCAGNNNCCCNNNNGNA NAANNNTGNAAGNNNNN NNNNNNNNNNNCANNN NN (SEQ ID NO: 3647) | |
| V-C064 | | NNNNNNNNNNNNNTCNT ACATATAGAGATTTAGGTGA CACTATAGAATAACATCCA CTTTGCCTTTCTCCACAG GTGTCCACTCCCAGGTCCA ACTGCACCTCGGTTCTATCG ATTGAATTCCACCATGGGA TGGTCATGTATCATCCTTTT TCTAGTAGCAACTGCAACC GGTGTACATTCTGAGGTGC AGCTGGTGGAGTCTGGGGG AGACAATTCCAAGAACGC GGGTCCCTGAGACTCTCCT GTGCAGCCTCTGGATTCAG TGTCAGCACCAAGTACATG ACATGGGTCCGTCAGGCTC CAGGGAAGGGGCTGGAGTG GGTCTCAGTTCTTACAGCG AGATCCGTGAAGGGCAGA TTCACCATCTCCAGAGACA | GAGGTGCAGCTGGTGGAGT CTGGGGGAGGCTTGGTCA GCCGGGGGGGTCCCTGAGA CTCTCCTGTGCAGCCTCTGG ATTCAGTGTCAGCACCAAG TACATGACATGGGTCCGTC AGGCTCCAGGGAAGGGGCT GGAGTGGGTCTCAGTTCTTT ACAGCGGTGGTAGTGATTA ACAGCGGTGGTAGTGATTA CTACGCAGAACTCCGTGAAG GGCAGATTCACCATCTCCA GAGACAATTCCAAGAACGC TTTATATCTTCAAATGAACA GCTTGAGAGTCGAGGACAC GGGTGTTTATTACTGTGCCA GAGACTCGTCGGAAGTCCG TGACCACCCCGGGCACCCA GGGCCGTCGGTCGGGGCTT TTGATATCTGAAGGCGCA GACAATGGTCACCGTCTCT CAG (SEQ ID NO: 311) | COV047_P4_A3 | NNNNNNNTATGNATNN TACATACAGATTAGGT GACATCATAGAATAACA TCCACTTTGCCTTTCTCT CCACAGGTGTCCACTCCC AGGTTCCAACTGCACCTC GGTTCTATCGATTGAATT CCACCATGGGATGGTCA TGTATCATCCTTTTTCTA GTAGCAACTGCAACCGG TTCCTGGGCCCAGTCTGC CCTGACAATTCTCGGCTC CGTGTCTGGGTCTCCTGG ACAGTCGATCACCATCTC CTGCACTGGAACCAGCA ATGATGTTGGAGTTAT ACCCCTTGTCTCCTGTAC CAACAGTACCCAGGCAA AGCCCCAAGCTCTTAAT TTTGAGGTCACTAAGCG GTCCTCAGGGATTCTAA | CAGTCTGTGCTGACTCAGCC TGCCTCCGTGTCTGGGTCTC CTGGACAGTCGATCACCATC TCCTGCACTGGAACCAGCAA TGATGTTGGAGTTATACCC TTGTCTCCTGGTACCAACAG TACCCAGGCAAAGCCCCA AGCTCTTAATTTTGAGGTC ACTAAGCGGTCCTCAGGGAT CCCTGACAATCTCTGGCTC CAGGGTGAAGACGAGGCTG ATTATATTGCTGCTCATAT GCAGGTGCTAGCACTTTCGT GTTCGGCGGAGGGACCAAG CTGACCGTCCTAG (SEQ ID NO: 3651) | COV047_P4_A3 |

TABLE 15-continued

Additional sequence information for the disclosed anti-SARS-CoV-2 antibodies

| ALICE AbsID | HEAVY CHAIN | | sequence ID (plate/well) | LIGHT CHAIN | | sequence ID (plate/well) |
|---|---|---|---|---|---|---|
| | miniprep sequence | original nt sequence | | miniprep sequence | original nt sequence | |
| | ATTCCAAGAACGCTTTATAT CTTCAAATGAACAGCTTGA GAGTCGAGGACACGGGTGT TTATTACTGTGCCAGAGACT CGTCGGAAGTCCGTGACCA CCCCGGGCACCCAGGGCGC TCGGTGGGGCTTTTGATAT CTGGGGCCAAGGGACAATG GTCACCGTCTCTTCAGCGTC GACCAAGGGCCCATCGGTC TTCCCCCTGGCACCCTCCTC CAAGAGCACCTCTGGGGGC ACAGCGGCCCTGGGCTGCC TGGTCAAGGACTACTTCCC CGAACCTGTGACGGTCTCG TGGAACTCAGGCGCCCTGA CCAGCGGCGTGCACACCTT CCCGGCTGTCTACAGTCCT CAGGACTCTACTCCCTCAG CAGCCTGGTGACCGTGCCC TCCAGCAGCTTGGGCACCC AGACCTACATCTGCAACGT GAATCACAAGCCCNGCAAC ACCCAAGNGGACAANANA GATGAGNCNNATNTTGTG NNNAAAATNNNNNATGNNC TCCCCGNNNNNNNCNANNN NNNNNNGGGGGGGGGNAA CNTTNNTCTTTNNNNNNNNC CCCCNAAAANNNAANNN NNNCNNTNNTGNNNNNCNN NNNCCNNNNANGTCNNNNN NGNGGNNGNNGNNNGTGA CCNNNNAAANNCCTNNNNG TCAANTTCAANNGGTNNNN GNANNN (SEQ ID NO: 3649) | | | TCGCTTCTCTGGTTCCAA GTCTGGCAACACGGCCT CCCTGACAATCTCTGGGC TCCAGGGTGAAGACGAG GCTGATTATTATTGCTGC TCATATGCAGGTGCTAG CACTTCGTGTTCGGCGG AGGGACCAAGCTGACCG TCCTAGGTCAGCCCAAG GCTGCCCCCTCGGTCACT CTGTTCCCACCCTGAGT GAGGAGCTTCAAGCCAA CAAGGCCACACTGGTGT GTCTCATAAGTGACTTCT ACCCGGGAGCCGTGACA GTGGCCTGGAAGGCAGA TAGCAGCCCCGTCAAGG CGGGAGTGGAGACCACC ACCCCCTCCAAACAAAG CAACAACAAGTACGCGG CCAGCAGCTACCTGAGC CTGACGCCTGAGCAGTG GAAGTCCCACAGAAGCT ACAGCTGCCAGGTCACG CATGAAGGGAGCACCGT GGAGAAGACAGTGCCC CTACAGAATGTTCATAG AAGCTTGGGCGCCATGG CCCAACTTGTTTATTGCA GCTTATAATGGTTACAA ATAAAGCAATAGCATCA CAAATTTCACAAATAAA GCATTTTTTTCACTGCAT TCTAGTTGTGGTTTGTCC AAACTTCATCAATGTATCT TATCATGTCTGATCGGG AATTAATTCGGCGCAGC ACCATGGNCTGAAATAN CTCTGAAAGAGGACTTG GNTAGGTACCTTCTGAN CGGAAANNACCATCTGN NGAATGNNTGTCANTTA GGGTGNNGAAAGTCCCC AGGNNNCCCNNNNNN (SEQ ID NO: 3650) | | |

TABLE 15-continued

Additional sequence information for the disclosed anti-SARS-CoV-2 antibodies

| ALICE AbsID | HEAVY CHAIN | | | LIGHT CHAIN | |
|---|---|---|---|---|---|
| | miniprep sequence | original nt sequence | sequence ID (plate/well) | miniprep sequence | original nt sequence | sequence ID (plate/well) |
| V-C065 | NNNNNNNNNNNNNNN NNTACNCATACGAATTAGG TGACACTATAGAATAACAT CCACTTTGCCTTTCTCTCCA CAGGTGTCCACTCCCAGGT CCAACTGCACCTCGGTTCTA TCGATTGAATTCCACCATG GGATGGTCATGTATCATCCT TTTCTAGTAGCAACTGCAA CCGGTGTACATTCCCAGGT GCAGCTGGTGCAGTCTGGG GCTGAGGTGAAGAAGCCTG GGTCGTCGGTGAAGGTCTC CTGCAAGGCTTCTGAGGC ACCTTCAGTAGCTATGCTAT CAACTGGGTGCGACAGGCC CCTGGACAAGGGCTTGAGT GGATGGGAAGGATCATCCC TATCGTTGGTATAGCAAAC TACGCACAGAAGTTCCAGG GCAGAGTCACGATTACGGC GGACAAATCCTCGAGCACA GCCTACATGGAGCTGAGCA GCCTGAGATCTGAGGACAC GGCCGTGTATTACTGTGCG AGAGATCCTCGGACCCCC AGCTAGATGATGCTTTTGAT ATCTGGGGCCAAGGGACAA TGGTCACCGTCTCTTCAGCG TCGACCAAGGGCCCATCGG TCTTCCCCCCTGGCACCCTCC TCCAAGAGCACCCTCTGGGG GCACAGCGGCCCTGGGCTG CCTGGTCAAGGACTACTTTC CCCGAACCTGTGACGGTCT CGTGGAACTCAGGCGCCCCT GACCAGCGGCGTGCACACC TTCCCGGCTGTCCTACAGTC CTCAGGACTCTACTCCCTCA GCAGCTGGTGACCGTGCC CTCCAGCAGCTTGGGCACC CAGACCTACATCTGCAACG TGAATCACAAGCCCAGCAA CACCNNNTGACAAGAGAG | CAGGTGCAGCTGGTGCAGT CTGGGGCTGAGGTGAAGAA GCCTGGGTCGTCGGTGAAG GTCTCCTGCAAGGCTTCTGG AGGCACCTTCAGTAGCTAT GCTATCAACTGGGTGCGAC AGGCCCCTGGACAAGGGCT TGAGTGGATGGGAAGGATC ATCCCTATCGTTGGTATAGC AAACTACGCACAGAAGTTC CAGGGCAGAGTCACGATTA CGGCGGACAAATCCTCGAG CACAGCCTACATGGAGCTG AGCAGCCTGAGATCTGAGG ACACGGCCGTGTATTACTG TGCGAGAGATCCTCGGAC CCCCAGCTAGATGATGCTTT TGATATCTGGGGCCAAGGG ACAATGGTCACCGTCTCTTC AG (SEQ ID NO: 3653) | COV072_ P3_D12 | NNNNNNCNNATNGATN NTACNCATACGATTAG GTGACACTATAGAATAA CATCCACTTTGCCTTTCT CTCCACAGTGTCCACTC CCAGGTCCAACTGCACC TCGGTTCTATCGATTGAA TTCCACCATGGGATGGTC ATGTATCATCCTTTTTCT AGTAGCAACTGCAACCG GTGTACATTCAGAAATT GTGTTGACGCAGTCTCCA GGCACCCTGTCTTTGTCT CCAGGGAAAGAGCCAC CCTCTCCTGCAGGGCCA GTCAGAGTGTTAGCAGC ACCTACTTAGCCTGGTAC CAGCAGAAACCTGGCCA GGCTCCCAGGCTCCTCAT CTATGGTGCATCCAGCA GGGCCACTGGCATCCCA GACAGGTTCAGTGGCAG TGGGTCTGGGACAGACT TCACTCTCACCATCAGCA GACTGGAGCCTGAAGAT TTTGCAGTGTATTACTGT CAGCAGTATGGTAGCTC ACCGTGGACGTTCGGC AAGGGACCAAGGTGGAA ATCAAACGTACGGTGGC TGCACCATCTGTCTTCAT CTTCCCGCCATCTGATGA GCAGTTGAAATCTGGAA CTGCCTCTGTTGTGTGCC TGCTGAATAACTTCTATC CCAGAGAGGCCAAAGTA CAGTGGAAGGTGGATAA CGCCCTCCAATCGGGTA ACTCCCAGGAGAGTGTC ACAGAGCAGGACAGCAA GGACAGCACCTACAGCC TCAGCAGCACCCTGACG CTGAGCAAAGCAGACTA CGAGAAAACAAGTCT | GAAATTGTGTTGACGCAGTC TCCAGGCACCCTGTCTTTGT CTCCAGGGAAAGAGCCAC CCTCTCCTGCAGGGCCAGTC AGAGTGTTAGCAGCACCTAC TTAGCCTGGTACCAGCAGAA ACCTGGCCAGGCTCCCAGGC TCCTCATCTATGGTGCATCC AGCAGGGCCACTGGCATCC CAGACAGGTTCAGTGGCAG TGGGTCTGGGACAGACTTCA CTCTCACCATCAGCAGACTG GAGCCTGAAGATTTTGCAGT GTATTACTGTCAGCAGTATG GTAGCTCACCGTGGACGTTC GGCCAAGGGACCAAGGTGG AAATCAAAC (SEQ ID NO: 3655) | COV072_ P3_D12 |

TABLE 15-continued

Additional sequence information for the disclosed anti-SARS-CoV-2 antibodies

| | | HEAVY CHAIN | | | LIGHT CHAIN | |
|---|---|---|---|---|---|---|
| ALICE | AbsID | miniprep sequence | original nt sequence | sequence ID (plate/well) | miniprep sequence | original nt sequence | sequence ID (plate/well) |
| | | TTGAGCCCAAATCTTGTGA CAAACTCACACATGCCCAC CGTGCCCAGCACCTGAACT CCTGGGGGACCGTCAGTC TTCCTCTNNCCCCAAACCCA ANGACNCCCTCATGATCNC CCNGANCCCTGANGNCNCN TGCGTGNNGCNGGANGNGN GNNNNNANNANCCNNNNN NNNCCNNGANNNNNNAANN TCNNCTGGNTACNNNGGAC NGCNNNGNNGGTGCATAAT GCCANNANNAANCNNGG NAGNANNNNNNNNAACNG NNCGTTNCNNNNNN (SEQ ID NO: 3652) | | | ACGCCTGCGAAGTCACC CATCAGGGCCTGAGCTC GCCCGTCACAAAGAGCT TCAACAGGGAGAGTGT TAGAAGCTTGGCCGCCA TGGCCCAACTTGTTTATT GCAGCTTATAATGGTTAC AAATAAAGCAATAGCAT CACAAATTTCACAAATA AAGCATTTTTTCACTGC ATTCTANTTGTGGTTTGN CCAAACTCATCAATGTAT CTTATCATGTCTGATCNN GGNATTAATTCNGCGCA NCACCATGNNCTGAAAT NACCTCTGAAANAGGAA CNTGNNNAAGGTACNNT CTGAAGCCCGNANNNNCA TCNNNNGAANGNNGGTC AAATNNNGGGNNNGNA ANGNNN (SEQ ID NO: 3654) | | |

TABLE 16

Crystallographic data collection and refinement statistics for C105 Fab structure (related to FIG. 21)

| | C105 Fab (12-1, SSRL) |
|---|---|
| PDB ID | XXXX |
| Data collection[a] | |
| Space group | I222 |
| Unit cell (Å) | 67.4, 120.1, 123.3 |
| α, β, γ (°) | 90, 90, 90 |
| Wavelength (Å) | 1.0 |
| Resolution (Å) | 38.9-1.80 (1.84-1.80) |
| Unique Reflections | 46,713 (2752) |
| Completeness (%) | 100 (99.8) |
| Redundancy | 6.8 (6.5) |
| CC1/2 (%) | 98.8 (54.1) |
| $<I/\sigma I>$ | 5.7 (1.2) |
| Mosaicity (°) | 0.19 |
| Rmerge (%) | 18.1 (157) |
| Rpim (%) | 7.9 (70.5) |
| Wilson B-factor | 16.8 |
| Refinement and Validation | |
| Resolution (Å) | 38.9-1.80 |
| Number of atoms | |
| Protein | 3,132 |
| Ligand | 10 |
| Waters | 477 |
| Rwork/Rfree (%) | 18.7/21.6 |
| R.m.s. deviations | |
| Bond lengths (Å) | 0.006 |
| Bond angles (°) | 0.853 |
| MolProbity score | 1.29 |
| Clashscore (all atom) | 4.2 |
| Poor rotamers (%) | 0 |
| Ramachandran plot | |
| Favored (%) | 97.6 |
| Allowed (%) | 2.4 |
| Disallowed (%) | 0 |
| Average B-factor (Å) | 27.1 |

[a]Numbers in parentheses correspond to the highest resolution shell

TABLE 16

Cryo-EM data collection and refinement statistics for C105-S complex structure (related to FIG. 21).

| | C105 SARS-CoV-2 S 2P (state 1) | C105 SARS-CoV-2 S 2P (state 2) |
|---|---|---|
| PDB | | |
| EMD | | |
| Microscope | Titan Krios | Titan Krios |
| Camera | GatanK3 Summit | GatanK3 Summit |
| Magnification | 105,000x | 105,000x |
| Voltage (kV) | 300 | 300 |
| Recording mode | counting | counting |
| Dose rate (e–/pixel/s) | 22.1 | 22.1 |
| Electron dose (e–/Å$^2$) | 60 | 60 |
| Defocus range (μm) | 1.0-2.5 | 1.0-2.5 |
| Pixel size (Å) | 0.418 (super resolution); 0.836 (binned) | 0.418 (super resolution); 0.836 (binned) |
| Micrographs collected | 5,940 | 5,940 |
| Micrographs used | 5,336 | 5,336 |
| Total extracted particles | 71,289 | 71,289 |
| Refined particles | 37,615 | 14,119 |
| Symmetry imposed | C1 | C3 |
| Nominal Resolution (Å) | | |
| FSC 0.5 (unmasked/masked) | 3.90/3.60 | 4.30/3.90 |
| FSC 0.143 (unmasked · masked) | 3.40/3.20 | 3.70/3.50 |
| Map sharpening B-factor | | |
| Refinement and Validation | | |
| Number of atoms | | |
| Protein | 25,973 | |
| Ligand | 711 | |
| MapCC (global/local) | 0.86/0.84 | |
| R.m.s. deviations | | |
| Bond lengths (Å) | 0.008 | |
| Bond angles (°) | 0.812 | |
| MolProbity score | 2.17 | |
| Clashscore (all atom) | 13.6 | |
| Poor rotamers (%) | 0.04 | |
| Ramachandran plot | | |
| Favored (%) | 90.9 | |
| Allowed (%) | 9 | |
| Disallowed (%) | 461 | |

TABLE 17

S protein mutations found in different SARS-CoV-2 isolates (related to FIG. 22)

| Mutation | Count | Frequency (%) | Location |
|---|---|---|---|
| D614G | 9688 | 63.2 | S1 domain D |
| P1263L | 115 | 0.7 | S2 cytoplasmic tail |
| L5F | 91 | 0.6 | signal sequence |
| D936Y | 88 | 0.6 | S2 HR1 |
| L54F | 58 | 0.4 | S1 domain A |
| G1124V | 56 | 0.4 | S2 |
| N439K | 38 | 0.2 | S1 domain B (RBD) |
| H49Y | 35 | 0.2 | S1 domain A |
| L18F | 31 | 0.2 | S1 domain A |
| L8V | 30 | 0.2 | signal sequence |
| A831V | 29 | 0.2 | S2 |
| D839Y | 28 | 0.2 | S2 |
| V483A | 28 | 0.2 | S1 domain B (RBD) |
| Q675H | 24 | 0.2 | S1 domain D |
| S50L | 24 | 0.2 | S1 domain A |
| S943P | 22 | 0.1 | S2 HR1 |
| A1078S | 21 | 0.1 | S2 |
| R21I | 19 | 0.1 | S1 domain A |
| V367F | 18 | 0.1 | S1 domain B (RBD) |
| T29I | 18 | 0.1 | S1 domain A |

List of SARS-CoV-2 spike mutations with a frequency ≥0.1% in a set of 15335 isolates downloaded from the Global Initiative for Sharing All Influenza Data (GISAID) SARS-CoV-2 sequence database on May 3, 2020 (Elbe and Buckland-Merrett, 2017; Shu and McCauley, 2017). The genomes were processed with the nextstrain augur pipeline (https://github.com/nextstrain/augur) (Hadfield et al., 2018), using MAFFT v7.464 (Katoh and Standley, 2013) for sequence alignment and FastTree (Price et al., 2010) to generate a phylogenetic tree. The resulting data were then analyzed with a custom Swift program.

REFERENCES

Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., et al. (2010). PHENIX: a comprehensive Python-based system for macromolecular structure solution. Acta Crystallogr D Biol Crystallogr 66, 213-221.

Bell, J. M., Chen, M., Baldwin, P. R., and Ludtke, S. J. (2016). High resolution single particle refinement in EMAN2.1. Methods 100, 25-34.

Bianchi, M., Turner, H. L., Nogal, B., Cottrell, C. A., Oyen, D., Pauthner, M., Bastidas, R., Nedellec, R., McCoy, L. E., Wilson, I. A., et al. (2018). Electron-Microscopy-Based Epitope Mapping Defines Specificities of Polyclonal Antibodies Elicited during HIV-1 BG505 Envelope Trimer Immunization. Immunity 49, 288-300 e288.

Briney, B., Inderbitzin, A., Joyce, C., and Burton, D. R. (2019). Commonality despite exceptional diversity in the baseline human antibody repertoire. Nature 566, 393-397.

Brouwer, P. J. M., Caniels, T. G., van der Straten, K., Snitselaar, J. L., Aldon, Y., Bangaru, S., Tones, J. L., Okba, N. M. A., Claireaux, M., Kerster, G., et al. (2020). Potent neutralizing antibodies from COVID-19 patients define multiple targets of vulnerability. bioRxiv 10.1101/2020.05.12.088716.

Cao, Y., Su, B., Guo, X., Sun, W., Deng, Y., Bao, L., Zhu, Q., Zhang, X., Zheng, Y., Geng, C., et al. (2020). Potent neutralizing antibodies against SARS-CoV-2 identified by high-throughput single-cell sequencing of convalescent patients' B cells. Cell 10.1016/j.cell.2020.05.025. Chen, V. B., Arendall, W. B., 3rd, Headd, J. J., Keedy, D. A., Immormino, R. M., Kapral, G. J., Murray, L. W., Richardson, J. S., and Richardson, D. C. (2010). MolProbity: all-atom structure validation for macromolecular crystallography. Acta Crystallogr D Biol Crystallogr 66, 12-21.

Chen, X., Li, R., Pan, Z., Qian, C., Yang, Y., You, R., Zhao, J., Liu, P., Gao, L., Li, Z., et al. (2020). Human monoclonal antibodies block the binding of SARS-CoV-2 Spike protein to angiotensin converting enzyme 2. medRxiv 10.1101/2020.04.06.20055475

Chi, X., Yan, R., Zhang, J., Zhang, G., Zhang, Y., Hao, M., Zhang, Z., Fan, P., Dong, Y., Yang, Y., et al. (2020). A potent neutralizing human antibody reveals the N-terminal domain of the Spike protein of SARS-CoV-2 as a site of vulnerability. bioRxiv 10.1101/2020.05.08.083964.

Crawford, K. H. D., Eguia, R., Dingens, A. S., Loes, A. N., Malone, K. D., Wolf, C. R., Chu, H. Y., Tortorici, A. M., Veesler, D., Murphy, M., et al. (2020). Protocol and reagents for pseudotyping lentiviral particles with SARS-CoV-2 Spike protein for neutralization assays. bioRxiv 10.1101/2020.04.20.051219.

de Wit, E., van Doremalen, N., Falzarano, D., and Munster, V. J. (2016). SARS and MERS: recent insights into emerging coronaviruses. Nat Rev Microbiol 14, 523-534.

Dunbar, J., Krawczyk, K., Leem, J., Baker, T., Fuchs, A., Georges, G., Shi, J., and Deane, C. M. (2014). SAbDab: the structural antibody database. Nucleic Acids Res 42, D1140-1146. Elbe, S., and Buckland-Merrett, G. (2017). Data, disease and diplomacy: GISAID's innovative contribution to global health. Glob Chall 1, 33-46.

Emsley, P., Lohkamp, B., Scott, W. G., and Cowtan, K. (2010). Features and development of Coot. Acta Crystallogr D Biol Crystallogr 66, 486-501.

Fung, T. S., and Liu, D. X. (2019). Human Coronavirus: Host-Pathogen Interaction. Annu Rev Microbiol 73, 529-557.

Goddard, T. D., Huang, C. C., and Ferrin, T. E. (2007). Visualizing density maps with UCSF Chimera. J Struct Biol 157, 281-287.

Graham, R. L., Donaldson, E. F., and Baric, R. S. (2013). A decade after SARS: strategies for controlling emerging coronaviruses. Nat Rev Microbiol 11, 836-848.

Gralinski, L. E., and Baric, R. S. (2015). Molecular pathology of emerging coronavirus infections. The Journal of pathology 235, 185-195.

Gristick, H. B., von Boehmer, L., West, A. P., Jr., Schamber, M., Gazumyan, A., Golijanin, J., Seaman, M. S., Fatkenheuer, G., Klein, F., Nussenzweig, M. C., et al. (2016). Natively glycosylated HIV-1 Env structure reveals new mode for antibody recognition of the CD4-binding site. Nat Struct Mol Biol 23, 906-915.

Gui, M., Song, W., Zhou, H., Xu, J., Chen, S., Xiang, Y., and Wang, X. (2017). Cryo-electron microscopy structures of the SARS-CoV spike glycoprotein reveal a prerequisite conformational state for receptor binding. Cell Res 27, 119-129.

Guindon, S., Dufayard, J. F., Lefort, V., Anisimova, M., Hordijk, W., and Gascuel, O. (2010). New algorithms and methods to estimate maximum-likelihood phylogenies: assessing the performance of PhyML 3.0. Syst Biol 59, 307-321.

Hadfield, J., Megill, C., Bell, S. M., Huddleston, J., Potter, B., Callender, C., Sagulenko, P., Bedford, T., and Neher, R. A. (2018). Nextstrain: real-time tracking of pathogen evolution. Bioinformatics 34, 4121-4123.

Hoffmann, M., Kleine-Weber, H., Schroeder, S., Kruger, N., Herrler, T., Erichsen, S., Schiergens, T. S., Herrler, G., Wu, N. H., Nitsche, A., et al. (2020). SARS-CoV-2 Cell Entry Depends on ACE2 and TMPRSS2 and Is Blocked by a Clinically Proven Protease Inhibitor. Cell 181, 271-280 e278.

Hwang, W. C., Lin, Y., Santelli, E., Sui, J., Jaroszewski, L., Stec, B., Farzan, M., Marasco, W. A., and Liddington, R. C. (2006). Structural basis of neutralization by a human anti-severe acute respiratory syndrome spike protein antibody, 80R. J Biol Chem 281, 34610-34616.

Ju, B., Zhang, Q., Ge, X., Wang, R., Yu, J., Ge, J., Lan, J., Yuan, J., Wang, H., Zhao, J., et al. (2020). Potent human neutralizing antibodies elicited 1 by SARS-CoV-2 infection. bioRxiv 10.1101/2020.03.21.990770.

Kabsch, W. (2010). XDS. Acta Crystallogr D Biol Crystallogr 66, 125-132.

Kane, M., Zang, T. M., Rihn, S. J., Zhang, F., Kueck, T., Alim, M., Schoggins, J., Rice, C. M., Wilson, S. J., and Bieniasz, P. D. (2016). Identification of Interferon-Stimulated Genes with Antiretroviral Activity. Cell Host Microbe 20, 392-405.

Katoh, K., and Standley, D. M. (2013). MAFFT multiple sequence alignment software version 7: improvements in performance and usability. Mol Biol Evol 30, 772-780.

Kirchdoerfer, R. N., Bhandari, M., Martini, O., Sewall, L. M., Bangaru, S., Yoon, K.-J., and Ward, A. B. (2020). Structure and immune recognition of the porcine epidemic diarrhea virus spike protein. bioRxiv 10.1101/2020.02.18.955195.

Kirchdoerfer, R. N., Cottrell, C. A., Wang, N., Pallesen, J., Yassine, H. M., Turner, H. L., Corbett, K. S., Graham, B. S., McLellan, J. S., and Ward, A. B. (2016). Pre-fusion structure of a human coronavirus spike protein. Nature 531, 118-121.

Kirchdoerfer, R. N., Wang, N., Pallesen, J., Wrapp, D., Turner, H. L., Cottrell, C. A., Corbett, K. S., Graham, B. S., McLellan, J. S., and Ward, A. B. (2018). Stabilized coronavirus spikes are resistant to conformational changes induced by receptor recognition or proteolysis. Scientific reports 8, 15701.

Klein, J. S., and Bjorkman, P. J. (2010). Few and far between: how HIV may be evading antibody avidity. PLoS Pathog 6, e1000908.

Korber, B., Fischer, W. M., Gnanakaran, S., Yoon, H., Theiler, J., Abfalterer, W., Foley, B., Giorgi, E. E., Bhattacharya, T., Parker, M. D., et al. (2020). Spike mutation pipeline reveals the emergence of a more transmissible form of SARS-CoV-2. bioRxiv 10.1101/2020.04.29.069054. Landau, M., Mayrose, I., Rosenberg, Y., Glaser, F., Martz, E., Pupko, T., and Ben-Tal, N. (2005). ConSurf 2005: the projection of evolutionary conservation scores of residues on protein structures. Nucleic Acids Res 33, W299-302.

Lefranc, M. P., Giudicelli, V., Duroux, P., Jabado-Michaloud, J., Folch, G., Aouinti, S., Carillon, E., Duvergey, H., Houles, A., Paysan-Lafosse, T., et al. (2015). IMGT®, the international ImMunoGeneTics information System® 25 years on. Nucleic Acids Res 43, D413-422.

Li, W., Moore, M. J., Vasilieva, N., Sui, J., Wong, S. K., Berne, M. A., Somasundaran, M., Sullivan, J. L., Luzuriaga, K., Greenough, T. C., et al. (2003). Angiotensin-converting enzyme 2 is a functional receptor for the SARS coronavirus. Nature 426, 450-454.

Li, Z., Tomlinson, A. C., Wong, A. H., Zhou, D., Desforges, M., Talbot, P. J., Benlekbir, S., Rubinstein, J. L., and Rini, J. M. (2019). The human coronavirus HCoV-229E S-protein structure and receptor binding. Elife 8.

Mastronarde, D. N. (2005). Automated electron microscope tomography using robust prediction of specimen movements. J Struct Biol 152, 36-51.

McCoy, A. J., Grosse-Kunstleve, R. W., Adams, P. D., Winn, M. D., Storoni, L. C., and Read, R. J. (2007). Phaser crystallographic software. J Appl Crystallogr 40, 658-674.

Neuman, B. W., Kiss, G., Kunding, A. H., Bhella, D., Baksh, M. F., Connelly, S., Droese, B., Klaus, J. P., Makino, S., Sawicki, S. G., et al. (2011). A structural analysis of M protein in coronavirus assembly and morphology. J Struct Biol 174, 11-22.

Nie, J., Li, Q., Wu, J., Zhao, C., Hao, H., Liu, H., Zhang, L., Nie, L., Qin, H., Wang, M., et al. (2020). Establishment and validation of a pseudovirus neutralization assay for SARS-CoV-2. Emerg Microbes Infect 9, 680-686.

Nogal, B., Bianchi, M., Cottrell, C. A., Kirchdoerfer, R. N., Sewall, L. M., Turner, H. L., Zhao, F., Sok, D., Burton, D. R., Hangartner, L., et al. (2020). Mapping Polyclonal Antibody Responses in Non-human Primates Vaccinated with HIV Env Trimer Subunit Vaccines. Cell reports 30, 37553765 e3757.

Ou, X., Liu, Y., Lei, X., Li, P., Mi, D., Ren, L., Guo, L., Guo, R., Chen, T., Hu, J., et a !. (2020). Characterization of spike glycoprotein of SARS-CoV-2 on virus entry and its immune cross-reactivity with SARS-CoV. Nat Commun 11, 1620.

Pallesen, J., Wang, N., Corbett, K. S., Wrapp, D., Kirchdoerfer, R. N., Turner, H. L., Cottrell, C. A., Becker, M. M., Wang, L., Shi, W., et al. (2017). Immunogenicity and structures of a rationally designed prefusion MERS-CoV spike antigen. Proc Natl Acad Sci USA 114, E7348-E7357. Pettersen, E. F., Goddard, T. D., Huang, C. C., Couch, G. S., Greenblatt, D. M., Meng, E. C., and Ferrin, T. E. (2004). UCSF Chimera—a visualization system for exploratory research and analysis. J Comput Chem 25, 1605-1612.

Pinto, D., Park, Y.-J., Beltramello, M., Walls, A. C., Tortorici, M. A., Bianchi, S., Jaconi, S., Culap, K., Zatta, F., De Marco, A., et al. (2020). Structural and functional analysis of a potent sarbecovirus neutralizing antibody. Nature 10.1038/s41586-020-2349-y.

Plotkin, S. A. (2001). Immunologic correlates of protection induced by vaccination. Pediatr Infect Dis J 20, 63-75.

Plotkin, S. A. (2008). Vaccines: correlates of vaccine-induced immunity. Clin Infect Dis 47, 401-409.

Plotkin, S. A. (2010). Correlates of protection induced by vaccination. Clin Vaccine Immunol 17, 1055-1065.

Prabakaran, P., Gan, J., Feng, Y., Zhu, Z., Choudhry, V., Xiao, X., Ji, X., and Dimitrov, D. S. (2006). Structure of severe acute respiratory syndrome coronavirus receptor-binding domain complexed with neutralizing antibody. J Biol Chem 281, 15829-15836.
Premkumar, L., Segovia-Chumbez, B., Jadi, R., Martinez, D. R., Raut, R., Markmann, A., Conraby, C., Barbtelt, L., Weiss, S. C., Park, Y. J., et al. (2020). The RBD Of The Spike Protein Of SARS-Group Coronaviruses Is A Highly Specific Target Of SARS-CoV-2 Antibodies But Not Other Pathogenic Human and Animal Coronavirus Antibodies. medRxiv 10.1101/2020.05.06.20093377.
Price, M. N., Dehal, P. S., and Arkin, A. P. (2010). FastTree 2—approximately maximum-likelihood trees for large alignments. PLoS One 5, e9490.
Punjani, A., Rubinstein, J. L., Fleet, D. J., and Brubaker, M. A. (2017). cryoSPARC: algorithms for rapid unsupervised cryo-EM structure determination. Nat Methods 14, 290-296.
Quinlan, B. D., Mou, H., Zhang, L., Guo, Y., He, W., Ojha, A., Parcells, M. S., Luo, G., Li, W., Zhong, G., et al. (2020). The SARS-CoV-2 receptor-binding domain elicits a potent neutralizing response without antibody dependent enhancement. 10.1101/2020.04.10.036418.
Raj, V. S., Mou, H., Smits, S. L., Dekkers, D. H., Muller, M. A., Dijkman, R., Muth, D., Demmers, J. A., Zaki, A., Fouchier, R. A., et al. (2013). Dipeptidyl peptidase 4 is a functional receptor for the emerging human coronavirus-EMC. Nature 495, 251-254.
Reguera, J., Santiago, C., Mudgal, G., Ordono, D., Enjuanes, L., and Casasnovas, J. M. (2012). Structural bases of coronavirus attachment to host aminopeptidase N and its inhibition by neutralizing antibodies. PLoS Pathog 8, e1002859.
Robbiani, D. F., Gaebler, C., Muecksch, F., Cetrulo Lorenzi, J. C., Wang, Z., Cho, A., Agudelo, M., Barnes, C. O., Finkin, S., Hagglof, T., et al. (2020). Convergent Antibody Responses to SARS-CoV-2 Infection in Convalescent Individuals. bioRxiv 10.1101/2020.05.13.092619. Rockx, B., *Corti*, D., Donaldson, E., Sheahan, T., Stadler, K., Lanzavecchia, A., and Baric, R. (2008). Structural basis for potent cross-neutralizing human monoclonal antibody protection against lethal human and zoonotic severe acute respiratory syndrome coronavirus challenge. J Virol 82, 3220-3235.
Rogers, T. F., Zhao, F., Huang, D., Beutler, N., Abbott, R. K., Callaghan, S., Garcia, E., He, W.-t., Hurtado, J., Limbo, O., et al. (2020). Rapid isolation of potent SARS-CoV-2 neutralizing antibodies and protection in a small animal model. bioRxiv 10.1101/2020.05.11.088674. Rohou, A., and Grigorieff, N. (2015). CTFFIND4: Fast and accurate defocus estimation from electron micrographs. J Struct Biol 192, 216-221.
Scharf, L., Wang, H., Gao, H., Chen, S., McDowall, A. W., and Bjorkman, P. J. (2015). Broadly Neutralizing Antibody 8ANC195 Recognizes Closed and Open States of HIV-1 Env. Cell 162, 1379-1390.

Schoofs, T., Barnes, C. O., Suh-Toma, N., Golijanin, J., Schommers, P., Gruell, H., West, A. P., Jr., Bach, F., Lee, Y. E., Nogueira, L., et al. (2019). Broad and Potent Neutralizing Antibodies Recognize the Silent Face of the HIV Envelope. Immunity 50, 1513-1529 e1519.

Seydoux, E., Homad, L. J., MacCamy, A. J., Parks, K. R., Hurlburt, N. K., Jennewein, M. F., Akins, N. R., Stuart, A. B., Wan, Y.-H., Feng, J., et al. (2020). Characterization of neutralizing antibodies 1 from a SARS-CoV-2 infected individual. bioRxiv 10.1101/2020.05.12.091298.

Shang, J., Ye, G., Shi, K., Wan, Y., Luo, C., Aihara, H., Geng, Q., Auerbach, A., and Li, F. (2020). Structural basis of receptor recognition by SARS-CoV-2. Nature 10.1038/s41586-0202179-y.

Shang, J., Zheng, Y., Yang, Y., Liu, C., Geng, Q., Tai, W., Du, L., Zhou, Y., Zhang, W., and Li, F. (2018). Cryo-Electron Microscopy Structure of Porcine Deltacoronavirus Spike Protein in the Prefusion State. J Virol 92.

Shu, Y., and McCauley, J. (2017). GISAID: Global initiative on sharing all influenza data—from vision to reality. Euro Surveill 22.

Sievers, F., Wilm, A., Dineen, D., Gibson, T. J., Karplus, K., Li, W., Lopez, R., McWilliam, H., Remmert, M., Soding, J., et al. (2011). Fast, scalable generation of high-quality protein multiple sequence alignments using Clustal Omega. Mol Syst Biol 7, 539.

Terwilliger, T. C., Adams, P. D., Afonine, P. V., and Sobolev, O. V. (2018). A fully automatic method yielding initial models from high-resolution cryo-electron microscopy maps. Nat Methods 15, 905-908.

Tortorici, M. A., and Veesler, D. (2019). Structural insights into coronavirus entry. Adv Virus Res 105, 93-116.

Tortorici, M. A., Walls, A. C., Lang, Y., Wang, C., Li, Z., Koerhuis, D., Boons, G. J., Bosch, B. J., Rey, F. A., de Groot, R. J., et al. (2019). Structural basis for human coronavirus attachment to sialic acid receptors. Nat Struct Mol Biol 26, 481-489.

Walls, A. C., Park, Y. J., Tortorici, M. A., Wall, A., McGuire, A. T., and Veesler, D. (2020). Structure, Function, and Antigenicity of the SARS-CoV-2 Spike Glycoprotein. Cell 181, 281-292 e286.

Walls, A. C., Tortorici, M. A., Bosch, B. J., Frenz, B., Rottier, P. J. M., DiMaio, F., Rey, F. A., and Veesler, D. (2016). Cryo-electron microscopy structure of a coronavirus spike glycoprotein trimer. Nature 531, 114-117.

Walls, A. C., Tortorici, M. A., Snijder, J., Xiong, X., Bosch, B. J., Rey, F. A., and Veesler, D. (2017). Tectonic conformational changes of a coronavirus spike glycoprotein promote membrane fusion. Proc Natl Acad Sci USA 114, 11157-11162.

Walls, A. C., Xiong, X., Park, Y. J., Tortorici, M. A., Snijder, J., Quispe, J., Cameroni, E., Gopal, R., Dai, M., Lanzavecchia, A., et al. (2019). Unexpected Receptor Functional Mimicry Elucidates Activation of Coronavirus Fusion. Cell 176, 1026-1039 e1015.

Wan, Y., Shang, J., Graham, R., Baric, R. S., and Li, F. (2020). Receptor Recognition by the Novel Coronavirus from Wuhan: an Analysis Based on Decade-Long Structural Studies of SARS Coronavirus. J Virol 94.

Wang, C., Li, W., Drabek, D., Okba, N. M. A., van Haperen, R., Osterhaus, A. D. M. E., van Kuppeveld, F. J. M., Haagmans, B. L., Grosveld, F., and Bosch, B.-J. (2020). A human monoclonal antibody blocking SARS-CoV-2 infection. Nature Communications 11.

Wang, L., Shi, W., Joyce, M. G., Modjarrad, K., Zhang, Y., Leung, K., Lees, C. R., Zhou, T., Yassine, H. M., Kanekiyo, M., et al. (2015). Evaluation of candidate vaccine approaches for MERS-CoV. Nat Commun 6, 7712.

Widjaja, I., Wang, C., van Haperen, R., Gutierrez-Alvarez, J., van Dieren, B., Okba, N. M. A., Raj, V. S., Li, W., Fernandez-Delgado, R., Grosveld, F., et al. (2019). Towards a solution to MERS: protective human monoclonal antibodies targeting different domains and functions of the MERS-coronavirus spike glycoprotein. Emerg Microbes Infect 8, 516-530.

Winn, M. D., Ballard, C. C., Cowtan, K. D., Dodson, E. J., Emsley, P., Evans, P. R., Keegan, R. M., Krissinel, E. B., Leslie, A. G., McCoy, A., et al. (2011). Overview of the CCP4 suite and current developments. Acta Crystallogr D Biol Crystallogr 67, 235-242.

Wrapp, D., and McLellan, J. S. (2019). The 3.1-Angstrom Cryo-electron Microscopy Structure of the Porcine Epidemic Diarrhea Virus Spike Protein in the Prefusion Conformation. Journal of Virology 93, e00923-00919.

Wrapp, D., Wang, N., Corbett, K. S., Goldsmith, J. A., Hsieh, C. L., Abiona, O., Graham, B. S., and McLellan, J. S. (2020). Cryo-EM structure of the 2019-nCoV spike in the prefusion conformation. Science 367, 1260-1263.

Wu, F., Wang, A., Liu, M., Wang, Q., Chen, J., Xia, S., Ling, Y., Zhang, Y., Xun, J., Lu, L., et al. (2020a). Neutralizing antibody responses to SARS-CoV-2 in a COVID-19 recovered patient cohort and their implications. bioRxiv 10.1101/2020.03.30.20047365.

Wu, F., Zhao, S., Yu, B., Chen, Y. M., Wang, W., Song, Z. G., Hu, Y., Tao, Z. W., Tian, J. H., Pei, Y. Y., et al. (2020b). A new coronavirus associated with human respiratory disease in China. Nature 579, 265-269.

Wu, H., Pfarr, D. S., Tang, Y., An, L. L., Patel, N. K., Watkins, J. D., Huse, W. D., Kiener, P. A., and Young, J. F. (2005). Ultra-potent antibodies against respiratory syncytial virus: effects of binding kinetics and binding valence on viral neutralization. J Mol Biol 350, 126-144.

Wu, Y., Wang, F., Shen, C., Peng, W., Li, D., Zhao, C., Li, Z., Li, S., Bi, Y., Yang, Y., et al. (2020c). A noncompeting pair of human neutralizing antibodies block COVID-19 virus binding to its receptor ACE2. Science 10.1126/science.abc2241.

Xiong, H., Wu, Y., Cao, J., Yang, R., Ma, J., Qiao, X., Yao, X., Zhang, B., Zhang, Y., Hou, W., et al. (2020). Robust neutralization assay based on SARS-CoV-2 S-bearing vesicular stomatitis virus (VSV) pseudovirus and ACE2-overexpressed BHK21 cells. 10.1101/2020.04.08.026948.

Xiong, X., Tortorici, M. A., Snijder, J., Yoshioka, C., Walls, A. C., Li, W., McGuire, A. T., Rey, F. A., Bosch, B. J., and Veesler, D. (2018). Glycan Shield and Fusion Activation of a Deltacoronavirus Spike Glycoprotein Fine-Tuned for Enteric Infections. J Virol 92.

Yan, R., Zhang, Y., Li, Y., Xia, L., Guo, Y., and Zhou, Q. (2020). Structural basis for the recognition of SARS-CoV-2 by full-length human ACE2. Science 367, 1444-1448.

Yuan, M., Wu, N. C., Zhu, X., Lee, C. D., So, R. T. Y., Lv, H., Mok, C. K. P., and Wilson, I. A. (2020). A highly conserved cryptic epitope in the receptor-binding domains of SARS-CoV-2 and SARS-CoV. Science 10.1126/science.abb7269.

Yuan, Y., Cao, D., Zhang, Y., Ma, J., Qi, J., Wang, Q., Lu, G., Wu, Y., Yan, J., Shi, Y., et al. (2017). Cryo-EM structures of MERS-CoV and SARS-CoV spike glycoproteins reveal the dynamic receptor binding domains. Nat Commun 8, 15092.

Zhou, G., and Zhao, Q. (2020). Perspectives on therapeutic neutralizing antibodies against the Novel Coronavirus SARS-CoV-2. Int J Biol Sci 16, 1718-1723.

Zhou, P., Yang, X. L., Wang, X. G., Hu, B., Zhang, L., Zhang, W., Si, H. R., Zhu, Y., Li, B., Huang, C. L., et al. (2020). A pneumonia outbreak associated with a new coronavirus of probable bat origin. Nature 579, 270-273.

Zost, S. J., Gilchuk, P., Chen, R. E., Case, J. B., Reidy, J. X., Trivette, A., Nargi, R. S., Sutton, R. E., Suryadevara, N., Chen, E. C., et al. (2020). Rapid isolation and profiling of a diverse panel of human monoclonal antibodies targeting the SARS-CoV-2 spike protein. bioRxiv 10.1101/2020.05.12.091462.

SEQUENCE LISTING (3656 sequences)

SEQ ID NO: 1 - protein, 124 aa, Artificial Sequence
  source: /note="Description of Artificial Sequence: Synthetic polypeptide"
EVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS

SEQ ID NO: 2 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 3 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAGDTAVYYCARDYGDFYFDYWGQGTLVTVSS

SEQ ID NO: 4 - protein, 108 aa, Artificial Sequence
  source: /note="Description of Artificial Sequence: Synthetic polypeptide"
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKLEIK

SEQ ID NO: 5 - protein, 128 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPISGGTNYAQKFQGRVTMTRDTSISTAYMELSRLRSDDTAVYYCASPASRGYSGYDHGYYYYMDVWGKGTTVTVSS

SEQ ID NO: 6 - protein, 107 aa, Artificial Sequence
  source: /note="Description of Artificial Sequence: Synthetic polypeptide"
AIRMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 7 - protein, 123 aa, Artificial Sequence
  source: /note="Description of Artificial Sequence: Synthetic polypeptide"
QVQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS

SEQ ID NO: 8 - protein, 108 aa, Artificial Sequence
  source: /note="Description of Artificial Sequence: Synthetic polypeptide"
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPWTFGQGTKVEIK

SEQ ID NO: 9 - protein, 125 aa, Artificial Sequence
  source: /note="Description of Artificial Sequence: Synthetic polypeptide"
QVQLVESGGGLVKPGGSLRLSCAASGFIFSDYCMSWIRRAPGKGLEWLSYISNSGTTRYYADSVKGRFTISRDNGRNSLYLQMDSLSAEDTAVYYCARRGDGSSSIYYYNYMDVWGKGTTVTVSS

SEQ ID NO: 10 - protein, 110 aa, Artificial Sequence
  source: /note="Description of Artificial Sequence: Synthetic polypeptide"
QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVL

SEQ ID NO: 11 - protein, 120 aa, Artificial Sequence
  source: /note="Description of Artificial Sequence: Synthetic polypeptide"
EVQLVESGGGVVQPGRSLRLSCAASGFTFSSYGMHWVRQAPGKGLEWVTVISYDGRNKYYADSVKGRFTISRDNSKNTLYLQMNSLRAEDTAVYYCAREFGDPEWYFDYWGQGTLVTVSS

SEQ ID NO: 12 - protein, 106 aa, Artificial Sequence
  source: /note="Description of Artificial Sequence: Synthetic polypeptide"
DIQMTQSPSTLSASVGDRVTITCRANQSISSWLAWYQQKPGKAPKLLIYKASSLESGVPSRFSGSGSGTEFTLTISSLQPDDFATYYCQQYNSYWTFGQGTKVEIK

SEQ ID NO: 13 - protein, 122 aa, Artificial Sequence
  source: /note="Description of Artificial Sequence: Synthetic polypeptide"
QVQLVQSGAEVKKPGASVKVSCMASGYTFTGYYMHWVRQAPGQGLEWMGWINPNSGGTNYAQKFQGRVTMTRDTSISTAYMELSRLRSDDTAVYYCARDSPFSALGASNDYWGQGTLVTVSS

SEQ ID NO: 14 - protein, 110 aa, Artificial Sequence
  source: /note="Description of Artificial Sequence: Synthetic polypeptide"
QSALTQPPSASGSPGQSVTISCTGTSSDVGGYNYVSWYQQHPGKAPKLMIYEVSKRPSGVPDRFSGSKSGNTASLTVSGLQAEDEAEYYCSSDAGSNNVVFGGGTKLTVL

SEQ ID NO: 15 - protein, 123 aa, Artificial Sequence
  source: /note="Description of Artificial Sequence: Synthetic polypeptide"
EVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS

SEQ ID NO: 16 - protein, 108 aa, Artificial Sequence
  source: /note="Description of Artificial Sequence: Synthetic polypeptide"
DIQLTQSPSSLSASVGDRVTITCRASQSISTYLNWYQQKPGKAPKLLIYAASSLQSGVPSRFSGSGSGTDFTLTISSLQPEDFATYYCQQSYSTPPWTFGQGTKVEIK

SEQ ID NO: 17 - protein, 138 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNRLLYCSSTSCYLDAVRQGYYYYYYMDVWGKGTTVTVSS

SEQ ID NO: 18 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 19 - protein, 127 aa, Artificial Sequence
  source: /note="Description of Artificial Sequence: Synthetic polypeptide"
EVQLVESGGGVVQPGRSLRLSCAASGFTFSRYGMHWVRQAPGKGLEWVAVISYDGSNKYYADSVKGRFTISRDNSKNTLYLQMNSLRAEDTAVYYCAKVTAPYCSGGSCYGGNFDYWGQGTLVTVSS

SEQ ID NO: 20 - protein, 107 aa, Artificial Sequence
  source: /note="Description of Artificial Sequence: Synthetic polypeptide"
AIRMTQSPSSLSASVGDRVTITCQASQDISNYLNWYQQKPGKAPKLLIYDASNLETGVPSRFSGSGSGTDFTFTINSLQPEDIATYYCQQYDNLPPTFGGGTKVEIK

SEQ ID NO: 21 - protein, 126 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGTIGYADSVKGRFTISRDNAKNSLYLQMNSLRAEDTAFYYCAKAGVRGIAAAGPDLNFDHWGQGTLVTVSS

SEQ ID NO: 22 - protein, 103 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRITFGQGTRLEIK

SEQ ID NO: 23 - protein, 121 aa, Artificial Sequence
  source: /note="Description of Artificial Sequence: Synthetic polypeptide"
EVQLVESGGGVVQPGRSLRLSCAASGFTFSNYAIHWVRQAPGKGLEWVAVISYDGSNKYYADSVKGRFTISRDNSKNTLYLQMNSLRAEDTAVYYCARDFDDSSFWAFDYWGQGTLVTVSS

SEQ ID NO: 24 - protein, 108 aa, Artificial Sequence
  source: /note="Description of Artificial Sequence: Synthetic polypeptide"
DIQLTQSPSSLSASVGDRVTITCRASQSIRSYLNWYQQKPGKAPKLLIYAASSLQSGVPSRFSGSGSGTDFTLTISSLQPDDFATYYCQQSYSTPPATFGQGTKLEIK

SEQ ID NO: 25 - protein, 120 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVPREGTPGFDPWGQGTLVTVSS

SEQ ID NO: 26 - protein, 108 aa, Artificial Sequence
  source: /note="Description of Artificial Sequence: Synthetic polypeptide"
SYELTQPPSVSVAPGKTARITCGENNIGSKSVHWYQQKPGQAPVLVIYYDSDRPSGIPERFSGSNSGNTATLTINRVEAGDEADYYCQVWDSSSDHVVFGGGTKLTVL

SEQ ID NO: 27 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVWQYYDSSGSFDYWGQGTLVTVSS

SEQ ID NO: 28 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK

SEQ ID NO: 29 - protein, 129 aa, Artificial Sequence
  source: /note="Description of Artificial Sequence: Synthetic polypeptide"
QVQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS

SEQ ID NO: 30 - protein, 107 aa, Artificial Sequence
  source: /note="Description of Artificial Sequence: Synthetic polypeptide"
DIQMTQSPSTLSASVGDSVTITCRASQSISSWLAWYQQKPGKAPKLLIYKASSLESGVPSRFSGSGSGTEFTLTISSLQPDDFATYYCQQYNNYRYTFGQGTKLEIK

SEQ ID NO: 31 - protein, 127 aa, Artificial Sequence
  source: /note="Description of Artificial Sequence: Synthetic polypeptide"
EVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGDCYSYYFDYWGQGTLVTVSS

SEQ ID NO: 32 - protein, 106 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIK

SEQ ID NO: 33 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARTMYYYDSSGSFDYWGQGTLVTVSS

SEQ ID NO: 34 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPHTFGGGTKVEIK

SEQ ID NO: 35 - protein, 127 aa, Artificial Sequence
  source: /note="Description of Artificial Sequence: Synthetic polypeptide"
EVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGNCYSYYFDYWGQGTLVTVSS

SEQ ID NO: 36 - protein, 106 aa, Artificial Sequence; identical to SEQ ID NO: 32
  source: /note="Description of Artificial Sequence: Synthetic polypeptide"

SEQ ID NO: 37 - protein, 123 aa, Artificial Sequence
  source: /note="Description of Artificial Sequence: Synthetic polypeptide"
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVGYDSSGYSGWYFDLWGRGTLVTVSS

SEQ ID NO: 38 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKVLIYAASSLQSGVPSRFSGSGSGTDFTLTISSLQPEDFATYYCQQSYSTPPLTFGGGTKVEIK

SEQ ID NO: 39 - protein, 119 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGVAVDWYFDLWGRGTLVTVSS

SEQ ID NO: 40 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL

SEQ ID NO: 41 - protein, 120 aa, Artificial Sequence
  source: /note="Description of Artificial Sequence: Synthetic polypeptide"
QVQLQQWGAGLLKPSETLSRTCAVFGGSFTNYYWSWIRQSPGKGLEWIGEINDSGITNYNPSLKSRVTISVDTSKNQFSLSLRSVTAADTAVYYCARRRSFSRPSSIDYWGQGTLVTVSS

SEQ ID NO: 42 - protein, 111 aa, Artificial Sequence
  source: /note="Description of Artificial Sequence: Synthetic polypeptide"
DIVMTQSPLSLPVTPGEPASISCRSSQSLLHRNGYNYLDWYLQKPGQSPQLLIYLGSNRASGVPDRFRGSGSGTDFTLKISRVEAEDVGVYYCMQALQTLTFGQGTRLEIK

SEQ ID NO: 43 - protein, 121 aa, Artificial Sequence
  source: /note="Description of Artificial Sequence: Synthetic polypeptide"
QLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPYCSGGSCNDAFDIWGQGTMVTVSS

SEQ ID NO: 44 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 45 - protein, 123 aa, Artificial Sequence
  source: /note="Description of Artificial Sequence: Synthetic polypeptide"
VQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS

SEQ ID NO: 46 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDTQRPSGVPDRFSGSIDSSSNSASLTISGLKTEDEADYYCQSYDINSRWVFGGGTKLTVL

SEQ ID NO: 47 - protein, 130 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPHCSSTSCPIFYYYYMDVWGKGTTVTVSS

SEQ ID NO: 48 - protein, 108 aa, Artificial Sequence
  source: /note="Description of Artificial Sequence: Synthetic polypeptide"
SYELTQPPSVSVAPGQTARITCGGNNIGSKSVHWYQQKPGQAPVLVVYDDSDRPSGIPERFSGSNSGNTATLTISRVEAGDEADYYCQVWDSSSDQGVFGGGTKLTVL

SEQ ID NO: 49 - protein, 117 aa, Artificial Sequence
  source: /note="Description of Artificial Sequence: Synthetic polypeptide"
QVQLVESGGGLIQPGGSLRLSCAASGFIVSSNYMSWVRQAPGKGLEWVSVIYSGGSTFYTDSVKGRFTISRDNSKNTLYLQMNSLRAEDTAVYYCVRDYGDFYFDYWGQGTLVTVSS

SEQ ID NO: 50 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGGGSETDFTLTISRLEPEDCAVYYCQQYGSSPRTFGQGTKVEIK

SEQ ID NO: 51 - protein, 117 aa, Artificial Sequence
  source: /note="Description of Artificial Sequence: Synthetic polypeptide"
QVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDYGDYYFDYWGQGTLVTVSS

SEQ ID NO: 52 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK

SEQ ID NO: 53 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTGYKPSLKSRVTISVDMSRNQFSLKVTSVTAADTAVYYCARKPLLYSDFSPGAFDIWGQGTMVTVSS

SEQ ID NO: 54 - protein, 108 aa, Artificial Sequence
  source: /note="Description of Artificial Sequence: Synthetic polypeptide"
EIVLTQSPGTLSLSPGERATLSCRASQTVTANYLAWYQQKPGQAPRLLIYGASKRATGIPDRFSGSGSGTDFTLSISRLEPEDFAVYYCQQYTTTPRTFGGGTKVEIK

SEQ ID NO: 55 - protein, 123 aa, Artificial Sequence
  source: /note="Description of Artificial Sequence: Synthetic polypeptide"
QVQLQQWGAGLLKPSETLSLSCAVYGGSLSGYYWSWIRQPPGKGLEWIGEINHFGSTGYNPSLKSRVTISVDTSKSQFSVKLSSVTAADTAVYYCARKPLLYSNLSPGAFDIWGQGTMVTVSS

SEQ ID NO: 56 - protein, 108 aa, Artificial Sequence
  source: /note="Description of Artificial Sequence: Synthetic polypeptide"
EIVLTQSPGTVSLSPGERATLSCWASQSVSASYLAWYQQKPGQAPRLLIYGASSRATGIPDRFSGSGSGTDFTLTISRLEPEDFAVYYCQQYGTTPRTFGGGTKVEIK

SEQ ID NO: 57 - protein, 118 aa, Artificial Sequence
  source: /note="Description of Artificial Sequence: Synthetic polypeptide"
QVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGWELPYDYWGQGTLVTVSS

SEQ ID NO: 58 - protein, 111 aa, Artificial Sequence
  source: /note="Description of Artificial Sequence: Synthetic polypeptide"
QSALTQPPSASGSPGQSVTISCTGTSSDVGGYKYVSWYQQHPGKAPKLMIYEVSKRPSGVPDRFSGSKSGNTASLTVSGLQAEDEADYYCSSYEGSNNFVVFGGGTKLTVL

SEQ ID NO: 59 - protein, 132 aa, Artificial Sequence
  source: /note="Description of Artificial Sequence: Synthetic polypeptide"
QLQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS

SEQ ID NO: 60 - protein, 108 aa, Artificial Sequence
  source: /note="Description of Artificial Sequence: Synthetic polypeptide"
SYELTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL

SEQ ID NO: 61 - protein, 122 aa, Artificial Sequence
  source: /note="Description of Artificial Sequence: Synthetic polypeptide"
QVQLVQSGAEVKKPGASVRVSCKASGYTFTSYGFSWVRQAPGQGLEWMGWISAYNGNTNFAQKLQGRVTMTTDTSTSTAYMELRSLRSDDTAVYYCARGEAVAGTTGFFDYWGQGTLVTVSS

SEQ ID NO: 62 - protein, 111 aa, Artificial Sequence
  source: /note="Description of Artificial Sequence: Synthetic polypeptide"
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGFVVFGGGTKLTVL

SEQ ID NO: 63 - protein, 120 aa, Artificial Sequence
  source: /note="Description of Artificial Sequence: Synthetic polypeptide"
QVQLQESGPGLVKPSGTLSLTCAVSGGSISSTNWWSWVRQPPGKGLEWIGEIYHTGSTNYNPSLKSRVTISVDKSKNQFSLKLSSVTAADTAVYYCVRDGGRPGDAFDIWGQGTMVTVSS

SEQ ID NO: 64 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL

SEQ ID NO: 65 - protein, 128 aa, Artificial Sequence
  source: /note="Description of Artificial Sequence: Synthetic polypeptide"
QVQLQQSGAEVKKPGESLKISCKGSGYSFTSYWIGWVRQMPGKGLEWMGIIYPGDSDTRYSPSFQGQVTISADKSISTAYMQWSSLKASDTAMYYCARSFRDDPRIAVAGPADAFDIWGQGTMVTVSS

SEQ ID NO: 66 - protein, 107 aa, Artificial Sequence
  source: /note="Description of Artificial Sequence: Synthetic polypeptide"
DIQMTQSPSTLSASVGDRVTITCRASQSISYWLAWYQQKPGKAPKLLIYQASSLESGVPSRFSGSESGTEFTLTISSLQPDDFATYYCQQYNSYPYTFGQGTKLEIK

SEQ ID NO: 67 - protein, 121 aa, Artificial Sequence
  source: /note="Description of Artificial Sequence: Synthetic polypeptide"
QVQLVESGGGVVQPGRSLRLSCAASGFTFSSHAMHWVRQAPGKGLEWVAVISYDGSNKYYADSVKGRFTISRDNSKNTLYLQMNSLRAEDTAVYYCAREDYYDSSGSFDYWGQGTLVTVSS

SEQ ID NO: 68 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 69 - protein, 125 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAVIWYDGSNKYYADSVKGRFTISRDNSKNTLYLQMNSLRAEDTAVYYCARGVNPDDILTGVDAFDIWGQGTMVTVSS

SEQ ID NO: 70 - protein, 107 aa, Artificial Sequence
  source: /note="Description of Artificial Sequence: Synthetic polypeptide"
DIQMTQSPSTLSASVGDRVTITCRASQSMSSWLAWYQQKPGNAPKLLIYKASSLESGVPSRFSGSGSGTEFTLTISSLQPDDFATYYCQQHNSSPLTFGGGTKVEIK

SEQ ID NO: 71 - protein, 117 aa, Artificial Sequence
  source: /note="Description of Artificial Sequence: Synthetic polypeptide"
QVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDQWGQGTLVTVSS

SEQ ID NO: 72 - protein, 110 aa, Artificial Sequence
  source: /note="Description of Artificial Sequence: Synthetic polypeptide"
QSVLTQPPSVSGAPGQRVTISCTGTSSNIGAGYDVHWYQQLPGRAPKVLISGNNIRPSEVPDRFSGSRSGTSASLAITSLQPEDEAQYYCQSYDSSLYAVFGGGTKLTVL

SEQ ID NO: 73 - protein, 120 aa, Artificial Sequence
  source: /note="Description of Artificial Sequence: Synthetic polypeptide"
QVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS

SEQ ID NO: 74 - protein, 112 aa, Artificial Sequence
  source: /note="Description of Artificial Sequence: Synthetic polypeptide"
DIVMTQSPLSLSVTPGEPASISCRSSQSLLHSNGNNYFDWYLQKPGQSPQLLIYLGSNRASGVPDRFSGSGSGTDFTLKISRVEAEDVGVYYCMQVLQIPYTFGQGTKLEIK

SEQ ID NO: 75 - protein, 118 aa, Artificial Sequence
  source: /note="Description of Artificial Sequence: Synthetic polypeptide"
QVQLVESGGGVVQPGRSLRLSCAASGFTYSTYAMHWVRQAPGKGLEWVAFISYDGSNKYYADSVKGRFTISRDNSKNTLYLQMNSLRAEDTAVYYCARDFYHNWFDPWGQGTLVTVSS

SEQ ID NO: 76 - protein, 112 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDRSSNSASLTISGLKTEDEADYYCQSYDSGNHWVVFGGGTRLTVL

SEQ ID NO: 77 - protein, 127 aa, Artificial Sequence
  source: /note="Description of Artificial Sequence: Synthetic polypeptide"
QVQLVESGGGVVQPGRSLRLSCAASGFTFSTYAMHWVRQAPGEGLEWVAVISYDGSNTYYADSVKGRFTISRDNSKNTLYLQMNSLRAEDTAVYYCARDPIWFGELLSPPFVHFDYWGQGTLVTVSS

SEQ ID NO: 78 - protein, 113 aa, Artificial Sequence
  source: /note="Description of Artificial Sequence: Synthetic polypeptide"
QSVLTQPPSVSAAPGQKVTISCSGSSSNIGNNLVSWYQQLPGTAPKLLIYENNKRPSGIPDRFSGSKSGTSATLGITGLQTGDEADYYCGAWDSSLSAGGVYVFGTGTKVTVL

SEQ ID NO: 79 - protein, 127 aa, Artificial Sequence
  source: /note="Description of Artificial Sequence: Synthetic polypeptide"
QVQLVESGGGVVQPGRSLRLSCAASGFTFSNYAMHWVRQAPGKGLEWVAVISYDGSNKYYADSVKGRFTISRDNSKNTLYLQMNSLRAEDTAIYYCASGYTGYDYFVRGDYYGLDVWGQGTTVTVSS

SEQ ID NO: 80 - protein, 111 aa, Artificial Sequence
  source: /note="Description of Artificial Sequence: Synthetic polypeptide"
QPVLTQSPSASASLGASVKLTCTLSSGHSSYAIAWHQQQPEKGPRYLMKLNTDGSHSKGDGIPDRFSGSSSGAERYLTISSLQSEDEADYYCQTWGTGILVFGGGTKLTVL

SEQ ID NO: 81 - protein, 127 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKLQGRVTMTRDTSTSTVYMELSSLRSEDTAVYYCARANHETTMDTYYYYYYMDVWGKGTTVTVSS

SEQ ID NO: 82 - protein, 111 aa, Artificial Sequence
  source: /note="Description of Artificial Sequence: Synthetic polypeptide"
QSALTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL

SEQ ID NO: 83 - protein, 118 aa, Artificial Sequence
  source: /note="Description of Artificial Sequence: Synthetic polypeptide"
EVQLVESGGGLIQPGGSLRLSCAASGFTVSSNYMTWVRQAPGKGLEWVSLIYPGGSTYYADSVKGRFTISRDNSKNTLYLQMNSLRAEDTAVYYCAREGMGMAAAGTWGQGTLVTVSS

SEQ ID NO: 84 - protein, 107 aa, Artificial Sequence
  source: /note="Description of Artificial Sequence: Synthetic polypeptide"
AIRMTQSPSSLSASVGDTVTITCQASQDISKYLNWYQQKPGKAPKLLIYDASNLETGVPSRFSGSGSGTDFTFTISSLQPEDIATYYCQQYDNLPQTFGGGTKVEIK

SEQ ID NO: 85 - protein, 129 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWISPVSGGTNYAQKFQGRVTMTRDTSISTAYMELSRLRSDDTAVYYCARAPLFPTGVLAGDYYYYGMDVWGQGTTVTVSS

SEQ ID NO: 86 - protein, 110 aa, Artificial Sequence
  source: /note="Description of Artificial Sequence: Synthetic polypeptide"
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTLVFGGGTKLTVL

SEQ ID NO: 87 - protein, 119 aa, Artificial Sequence
  source: /note="Description of Artificial Sequence: Synthetic polypeptide"
EVQLVESGGGLIQPGGSLRLSCAASGLTVSSNYMSWVRQAPGKGLEWVSVLYSGGSSFYADSVKGRFTISRDNSKNTLYLQMNSLRAEDTAVYYCARESGDTTMAFDYWGQGTLVTVSS

SEQ ID NO: 88 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSDSYTFGQGTKLEIK

SEQ ID NO: 89 - protein, 116 aa, Artificial Sequence
  source: /note="Description of Artificial Sequence: Synthetic polypeptide"
EVQLVESGGGLIQPGGSLRLSCAASGVTVSRNYMSWVRQAPGKGLEWVSVIYSGGSTYYADSVKGRFTISRDNSKNTLYLQMNSLRAEDTAVYYCARDLSAAFDIWGQGTMVTVSS

SEQ ID NO: 90 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPAFGQGTRLEIK

SEQ ID NO: 91 - protein, 125 aa, Artificial Sequence
  source: /note="Description of Artificial Sequence: Synthetic polypeptide"
EVQLVESGGGLVQPGGSLRLSCAASGFTFSGYSMNWVRQAPGKGPEWVSYISRSSSTIYYADSVKGRFTISRDNAKNSLYLQMNSLRDEDTAVYYCAREGARVGATYDTYYFDYWGQGTLVTVSS

SEQ ID NO: 92 - protein, 109 aa, Artificial Sequence
  source: /note="Description of Artificial Sequence: Synthetic polypeptide"
EIVLTQSPATLSLSPGERATLSCRASQSFSSYLAWYQQKPGQAPRLLIYDASNRATGIPARFSGSGSGTDFTLTISSLEPEDFAVYYCQQRNNWPPEWTFGQGTKVEIK

SEQ ID NO: 93 - protein, 123 aa, Artificial Sequence
  source: /note="Description of Artificial Sequence: Synthetic polypeptide"
QVQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCSDAFDIWGQGTMVTVSS

SEQ ID NO: 94 - protein, 108 aa, Artificial Sequence; identical to SEQ ID NO: 44
  source: /note="Description of Artificial Sequence: Synthetic polypeptide"

SEQ ID NO: 95 - protein, 118 aa, Artificial Sequence
  source: /note="Description of Artificial Sequence: Synthetic polypeptide"
QVQLQESGPGLVKPSETLSLSCAVSGGSIGSYFWSWIRQPPGKGLEWIGYLHYSGSTNYNPSLKSRVTISVDTSKNQFSLKLSSVTAADTAVYYCARLQWLRGAFDIWGQGTMVTVSS

SEQ ID NO: 96 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVINEDNQRPSGVPDRFSGSIDSSSNSASLTISGLKTEDEADYYCQSYDSSNLVFGGGTKLTVL

SEQ ID NO: 97 - protein, 125 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATAHPRRIQGVFFLGPGVWGQGTTVTVSS

SEQ ID NO: 98 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 99 - protein, 125 aa, Artificial Sequence
  source: /note="Description of Artificial Sequence: Synthetic polypeptide"
EVQLLESGGGLVQPGGSLRLSCAASGFTFSTYAMSWVRQAPGKGLEWVSTITGSGRDTYYADSVKGRFTISRDNSKNTLFLQLNSLRAEDAAVYSCANHPLASGDDYYHYYMDVWGKGTTVTVSS

SEQ ID NO: 100 - protein, 109 aa, Artificial Sequence
  source: /note="Description of Artificial Sequence: Synthetic polypeptide"
EIVLTQSPGTLSLSPGERATLSCRASQSVNSRQLAWYQQKPGQAPRLLIYGASSRATGIPERFSGSGSGTDFTLTISRLESEDFAVYHCQQYGSSRALTFGGGTKVEIK

SEQ ID NO: 101 - protein, 125 aa, Artificial Sequence
  source: /note="Description of Artificial Sequence: Synthetic polypeptide"
QVQLVESGGGVVQPGRSLRLSCAASGFTFSSYGMNWVRQAPGKGLEWVAVISYDGSNTYYTDSVKGRFTISRDNSKNTLYLQMNSLRVDDTATYYCAKGPRFGWSYRGGSGFDIWGQGTMVTVSS

SEQ ID NO: 102 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSESGTDFTFTISSLQPEDIATYYCQQYDNLPITFGQGTRLEIK

SEQ ID NO: 103 - protein, 120 aa, Artificial Sequence
  source: /note="Description of Artificial Sequence: Synthetic polypeptide"
QVQLVQSGAEVKKPGASVKVSCKASGYTFTNYYMHWVRQAPGQGLEWMGIINPSGGSTGYAQKFQGRVTMTRDTSTSTVYMELSSLRSEDTAVYYCARSRPTPDWYFDLWGRGTLVTVSS

SEQ ID NO: 104 - protein, 110 aa, Artificial Sequence
  source: /note="Description of Artificial Sequence: Synthetic polypeptide"
SYELTQPPSVSVAPGKTARITCGGNNIGSKSVHWYQQKPGQAPVLVIYYDSDRPSGIPERFSGSNSGNTATLTISRVEAGDEADYYCQVWDSSSDHPGVVFGGGTKLTVL

SEQ ID NO: 105 - protein, 122 aa, Artificial Sequence
  source: /note="Description of Artificial Sequence: Synthetic polypeptide"
QVQLVQSGSEVKKPGSSVKVSCKASGGTFSSYAFSWVRQAPGQGLEWMGRIIPILALANYAQKFQGRVTITADKSTSTAYMELSSLRSEDTAVYYCARVNQAVTTPFSMDVWGQGTTVTVSS

SEQ ID NO: 106 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPITFGQGTRLEIK

SEQ ID NO: 107 - protein, 122 aa, Artificial Sequence
  source: /note="Description of Artificial Sequence: Synthetic polypeptide"
QVQLQESGPGLVKPSGTLSLTCAVSGGSISSNNWWSCVRQPPGKGLEWIGEIYHSGSTNYNPSLKSRVTISVDKSKNQFSLKLSSVTAADTAVYYCARGGDTAMGPEYFDYWGQGTLVTVSS

SEQ ID NO: 108 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL

SEQ ID NO: 109 - protein, 123 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDSDVDTSMVTWFDYWGQGTLVTVSS

SEQ ID NO: 110 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 111 - protein, 123 aa, Artificial Sequence
  source: /note="Description of Artificial Sequence: Synthetic polypeptide"
EVQLLESGGGLVQPGGSLRLSCAASGFTFSNYAMSWVRQAPGKGLEWVSAISGSDGSTYYAGSVKGRFTISRDNSKNTLYLQMNSLRAEDTAVYYCAKDPLITGPTYQYFHYWGQGTLVTVSS

SEQ ID NO: 112 - protein, 110 aa, Artificial Sequence
  source: /note="Description of Artificial Sequence: Synthetic polypeptide"
SYELTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL

SEQ ID NO: 113 - protein, 119 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSS

SEQ ID NO: 114 - protein, 107 aa, Artificial Sequence
  source: /note="Description of Artificial Sequence: Synthetic polypeptide"
DIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIK

SEQ ID NO: 115 - protein, 119 aa, Artificial Sequence
  source: /note="Description of Artificial Sequence: Synthetic polypeptide"
EVQLVESGGGLVQPGGSLRLSCAASGFTFSTYWMSWVRQPPGKGLEWVANIKQDGSEKYYVDSVKGRFTISRDNAKNSLYLQMNSLRADDTAVYYCAGGTWLRSSFDYWGQGTLVTVSS

SEQ ID NO: 116 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL

SEQ ID NO: 117 - protein, 121 aa, Artificial Sequence
  source: /note="Description of Artificial Sequence: Synthetic polypeptide"
EVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS

SEQ ID NO: 118 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 119 - protein, 117 aa, Artificial Sequence
  source: /note="Description of Artificial Sequence: Synthetic polypeptide"
EVQLVESGGGLVQPGGSLRLSCAASGVTVSSNYMSWVRQAPGKGLEWVSLIYSGGSTFYADSVKGRFTISRDNSENTLYLQMNTLRAEDTAVYYCARDLYYYGMDVWGQGTTVTVSS

SEQ ID NO: 120 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYSYTFGQGTKLEIK

SEQ ID NO: 121 - protein, 124 aa, Artificial Sequence
  source: /note="Description of Artificial Sequence: Synthetic polypeptide"
EVQLVESGGGVVQPGRSLRLSCAASGFTFSSYAMFWVRQAPGKGLEWVAVISYDGSNKYYADSVKGRFTISRDNSKNTLYLQMNSLRAEDTAVYYCARADLGYCTNGVCYVDYWGQGTLVTVSS

SEQ ID NO: 122 - protein, 110 aa, Artificial Sequence; identical to SEQ ID NO: 116
  source: /note="Description of Artificial Sequence: Synthetic polypeptide"

SEQ ID NO: 123 - protein, 129 aa, Artificial Sequence [sequence omitted]

SEQ ID NO: 124 - protein, 110 aa, Artificial Sequence
  source: /note="Description of Artificial Sequence: Synthetic polypeptide"
QSALTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL

SEQ ID NO: 125 - protein, 131 aa, Artificial Sequence
  source: /note="Description of Artificial Sequence: Synthetic polypeptide"
EVQLVESGGGLIQPGGSLRLSCAASGFTVSNNYMSWVRQAPGKGLEWVSVIYSGGSTYYADSVKGRFTISRDKSKNTLYLQMNRLRAEDTAVYYCAREGEVEGYNDFWSGYSRDRYYFDYWGQGTLVTVSS

SEQ ID NO: 126 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 127 - protein, 131 aa, Artificial Sequence
  source: /note="Description of Artificial Sequence: Synthetic polypeptide"
EVQLVESGGGLIQPGGSLRLSCAASGFSVSSNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS

SEQ ID NO: 128 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL

SEQ ID NO: 129 - protein, 120 aa, Artificial Sequence
  source: /note="Description of Artificial Sequence: Synthetic polypeptide"
EVQLVESGGGLVKPGGSLRLSCAASGLTFTAYRMNWVRQAPGKGLEWLSSISNTNGDIYYADSVKGRFTISRDNAKNSLYLQMNSLRADDTAVYYCARDVASNYAYFDLWGQGTLVTVSS

SEQ ID NO: 130 - protein, 111 aa, Artificial Sequence
  source: /note="Description of Artificial Sequence: Synthetic polypeptide"
QSALTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL

SEQ ID NO: 131 - protein, 120 aa, Artificial Sequence
  source: /note="Description of Artificial Sequence: Synthetic polypeptide"
EVQLVQSGAEVKKPGESLKISCKGSGYRFTNYWIGWVRQMPGKGLEWMGIIYPGDSDTRYSPSFQGQVTISADKSITTAYLQWSSLKASDTAMYYCARLSDRWYSPFDPWGQGTLVTVSS

SEQ ID NO: 132 - protein, 110 aa, Artificial Sequence
  source: /note="Description of Artificial Sequence: Synthetic polypeptide"
QAVVTQEPSLTVSPGGTVTLTCGSSTGAVTSGHYPYWFQQKSGQAPRTLIYETSIKHSWTPARFSGSLLGGKAALTLSGAQPEDEADYYCLLSYSGARPVFGGGTKLTVL

SEQ ID NO: 133 - protein, 115 aa, Artificial Sequence
  source: /note="Description of Artificial Sequence: Synthetic polypeptide"
EVQLVESGGGLVQPGGSQRLSCAASGFTVSSNYMSWIRQAPGKGLEWVSVIYSGGSAYYVDSVKGRFTISRDNSKNTLYLQMNSLRPEDTAVYYCARIANYMDVWGKGTTVTVSS

SEQ ID NO: 134 - protein, 108 aa, Artificial Sequence
  source: /note="Description of Artificial Sequence: Synthetic polypeptide"
EIVMTQSPATLSVSPGERATLSCRASQSVSSHLAWYQQKPGQAPRLLIYGASTRATGIPTRFSGSGSGTEFTLTISSLQSEDFAVYYCQQYNNWPPLTFGGGTKVEIK

SEQ ID NO: 135 - protein, 125 aa, Artificial Sequence
  source: /note="Description of Artificial Sequence: Synthetic polypeptide"
QVQLVESGGGVVQPGRSLRLSCAASGFTFSTYGMHWVRQAPGKGLEWVAVISYDGSNKYFADSVKGRFTISRDNSKNTLYLQMNSLRPEDTAVYYCAKVGMEYSSGWYGEEIDFWGQGTLVTVSS

SEQ ID NO: 136 - protein, 107 aa, Artificial Sequence
  source: /note="Description of Artificial Sequence: Synthetic polypeptide"
DIQMTQSPSSLSASVGDRVTITCRASQSISSYLNWYQQKPGKVPKLLIYAASSLQSGVPSRFSGSGSGTDFTLTISSLQPEDFATYYCQQSYRTPLTFGGGTKVEIK

SEQ ID NO: 137 - protein, 127 aa, Artificial Sequence
  source: /note="Description of Artificial Sequence: Synthetic polypeptide"
EVQLVESGGGLVQPGGSLRLSCVASGFTFSSYWMHWVRQVPGKGPVWVSHINSEGSSTNYADSVRGRFTISRDNAKDTLYLQMNNLRAEDTAVYYCARPTAVAAAGNYFYYYGMDVWGQGTTVTVSS

SEQ ID NO: 138 - protein, 110 aa, Artificial Sequence
  source: /note="Description of Artificial Sequence: Synthetic polypeptide"
QSALTQPASVSGSPGQSITISCTGTSSDVGYYNFVSWYQQHPGKAPKLMIYEVSNRPSGVSNRFSGSKSGNTASLIISGLQAEDEADYYCSSYRSSSTLVFGGGTKLTVL

SEQ ID NO: 139 - protein, 122 aa, Artificial Sequence
  source: /note="Description of Artificial Sequence: Synthetic polypeptide"
EVQLVESGGGLVKPGGSLRLSCAASGFTFSSYNMNWVRQAPGKGLEWVSCISSSSSYIYYADSVKGRFTISRDNAKNSLYLQMNSLRAEDTAVYYCARERGYDGGKTPPFLGGQGTLVTVSS

SEQ ID NO: 140 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNYWVFGGGTKLTVL

SEQ ID NO: 141 - protein, 130 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVFYCARDRGGHDFWSGYGFYYYYGMDVWGQGTTVTVSS

SEQ ID NO: 142 - protein, 107 aa, Artificial Sequence
  source: /note="Description of Artificial Sequence: Synthetic polypeptide"
DIQMTQSPSSLSASVGDRVTITCRASQGISNYLAWYQQRPGKVPKLLIFAASTLQSGVPSRFSGSGSGTDFTLTISSLQPEDVATYYCQKYNSAPRTFGQGTKVEIK

SEQ ID NO: 143 - protein, 122 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGYSTYYVDSVKGRFTISRDNSKNTLYLQMNSLRAEDTAVYYCARVGGAHSGYDGSFDYWGQGTLVTVSS

SEQ ID NO: 144 - protein, 110 aa, Artificial Sequence
  source: /note="Description of Artificial Sequence: Synthetic polypeptide"
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 145 - protein, 127 aa, Artificial Sequence
  source: /note="Description of Artificial Sequence: Synthetic polypeptide"
QVQLVESGGGVVQPGRSLRLSCAASGFTFSRYGMHWVRQAPGKGLEWVAVMSYDGSSKYYADSVKGRFTISRDNSKNTLCLQMNSLRAEDTAVYYCAKQAGPYCSGGSCYSAPFDYWGQGTLVTVSS

SEQ ID NO: 146 - protein, 107 aa, Artificial Sequence
  source: /note="Description of Artificial Sequence: Synthetic polypeptide"
DIQMTQSPSSLSASVGDRVTITCQASQGISNYLNWYQQKPGKAPKLLIYDASNLETGVPSRFSGSGSGTDFTFTISSLQPEDIATYYCQQYDNLPITFGQGTRLEIK

SEQ ID NO: 147 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDFGEFYFDYWGQGTLVTVSS

SEQ ID NO: 148 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATAIPARFSGSGSGTEFTLTISSLQSEDFAVYYCQQYNNWPRTFGQGTKVEIK

SEQ ID NO: 149 - protein, 124 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVISYDGNNKYYADSVKGRFTISRDNSKNTLYLQMNSLRAEDTAVYYCAKDPFPLAVAGTGYFDYWGQGTLVTVSS

SEQ ID NO: 150 - protein, 108 aa, Artificial Sequence
  source: /note="Description of Artificial Sequence: Synthetic polypeptide"
SYELTQPPSVSVAPGQTARISCGGNNIGSKNVHWYQQKPGQAPVLVVYDDSDRPSGIPERFSGSNSGNTATLTISRVEAGDEADYYCQVWDSSSDPWVFGGGTKLTVL

SEQ ID NO: 151 - protein, 127 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVPASYGDDDYYYYYGMDVWGQGTTVTVSS

SEQ ID NO: 152 - protein, 108 aa, Artificial Sequence
  source: /note="Description of Artificial Sequence: Synthetic polypeptide"
SYELTQPPSVSVSPGQTARITCSGDALPKQYAYWYQQKPGQAPVLVIYKDSERPSGIPERFSGSSSGTTVTLTISGVQAEDEADYYCQSADSSGTLWVFGGGTKLTVL

SEQ ID NO: 153 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKPSLKSRVTISVDMSRNQFSLIMTSVTAADTAVYYCARKTLLFSDFSPGAFDIWGQGTMVTVSS

SEQ ID NO: 154 - protein, 107 aa, Artificial Sequence
  source: /note="Description of Artificial Sequence: Synthetic polypeptide"
EIVLTQSPGTLSLSPGERATLSCRASQTLTANYLAWYQQKPGQAPRLLIYGASKRATGIPDRFSGSGSGTDFTLSISRLEPEDFAVYYCQQYGTTPRTFGGGTKVEI

SEQ ID NO: 155 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKASLKSRVTISVGMSRNQFSLKVTSLTAADTAVYYCARKPLLYSDFSPGAFDVWGQGTMVTVSS

SEQ ID NO: 156 - protein, 107 aa, Artificial Sequence
  source: /note="Description of Artificial Sequence: Synthetic polypeptide"
EIVLTQSPGTLSLSPGERATLSCRASQTLTANYLAWYQQKPGQAPRLLIYGASKRAAGIPDRFSGSGSGTDFTLSITRLEPEDFAVYYCQQYHTTPRTFGGGTKVEI

SEQ ID NO: 157 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKPSLKSRVTISVDMSRNQFSLKVTSVTAADTAVYYCARKPLLHSDLSPGAFDIWGQGTMVTVSS

SEQ ID NO: 158 - protein, 107 aa, Artificial Sequence
  source: /note="Description of Artificial Sequence: Synthetic polypeptide"
EIVLTQSPGTLSLSPGERATLSCRASQTVSANYLAWYQQKAGQAPRLLIYGASKRATGIPDRFSGSGSGTDFTLSISRLEPEDFAVYYCQQYVTTPRTFGGGTKVEI

SEQ ID NO: 159 - protein, 129 aa, Artificial Sequence [sequence omitted]

SEQ ID NO: 160 - protein, 110 aa, Artificial Sequence
  source: /note="Description of Artificial Sequence: Synthetic polypeptide"
QSALTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL

SEQ ID NO: 161 - protein, 122 aa, Artificial Sequence
  source: /note="Description of Artificial Sequence: Synthetic polypeptide"
QVQLVQSGAEVKKPGSSVKVSCKASGGTFSSYAINWVRQAPGQGLEWMGRIIPIVGIANYAQKFQGRVTITADKSSSTAYMELSSLRSEDTAVYYCARDLLDPQLDDAFDIWGQGTMVTVSS

SEQ ID NO: 162 - protein, 108 aa, Artificial Sequence
  source: /note="Description of Artificial Sequence: Synthetic polypeptide"
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPWTFGQGTKVEIK

SEQ ID NO: 163 - protein, 121 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVKGVEYSSSSNFDYWGQGTLVTVSS

SEQ ID NO: 164 - protein, 106 aa, Artificial Sequence
  source: /note="Description of Artificial Sequence: Synthetic polypeptide"
IRMTQSPSSVSASVGDRVTITCRASQGISSWLAWYQQKPGKAPKLLIYVESSLQSGVPSRFSGSGSGTDFTLTISSLQPEDFATYYCQQANSFPLTFGGGTKVEIK

SEQ ID NO: 165 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTLGRGGDYWGQGTLVTVSS

SEQ ID NO: 166 - protein, 107 aa, Artificial Sequence
  source: /note="Description of Artificial Sequence: Synthetic polypeptide"
DIQLTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK

SEQ ID NO: 167 - protein, 126 aa, Artificial Sequence
  source: /note="Description of Artificial Sequence: Synthetic polypeptide"
EVQLLESGGGLEQPGGSLRLSCAASGFTFSTYAMSWVRQAPGKGLEWVSAISGSGAGTFYADSVKGRFTISRDNSKNTLYLQMNSLRAEDTAVYYCARESDCGSTSCYQVGWFDPWGQGTLVTVSS

SEQ ID NO: 168 - protein, 108 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 169 - protein, 124 aa, Artificial Sequence
  source: /note="Description of Artificial Sequence: Synthetic polypeptide"
QVQLVQSGAEVKKPGASVKVSCKASGHTFTSYYMHWVRQAPGQGLEWMGIINPSGGSTSYAQKFQGRVTMTRDTSTSTVYMELSSLRSEDTAVYYCARGPERGIVGATDYFDYWGQGTLVTVSS

SEQ ID NO: 170 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYVSSPWTFGQGTKVEIK

SEQ ID NO: 171 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEPIGQPLLWWDYWGQGTLVTVSS

SEQ ID NO: 172 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPRGFGQGTKVEIK

SEQ ID NO: 173 - protein, 119 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISTAYLKWSSLKASDSAMYYCARGPNLQNWFDPWGQGTLVTVSS

SEQ ID NO: 174 - protein, 107 aa, Artificial Sequence
  source: /note="Description of Artificial Sequence: Synthetic polypeptide"
EIVLTQSPGTLSLSPGERATLSCRASQSVSGSYLAWYQQRPGQAPRLLIYGASSRATGIPDRFSGSGSGTDFTLTISRLEPEDFAVYYCQQYGSSLTFGGGTKVEIK

SEQ ID NO: 175 - protein, 119 aa, Artificial Sequence
  source: /note="Description of Artificial Sequence: Synthetic polypeptide"
  MOD_RES (82)..(82): Any amino acid
  MOD_RES (87)..(87): Any amino acid
  MOD_RES (89)..(90): Any amino acid
  MOD_RES (98)..(98): Any amino acid
  MOD_RES (113)..(113): Any amino acid
  MOD_RES (117)..(117): Any amino acid
QVQLVQSGAEVKKSGASVKVSCKASGYTFTSYDINWVRQATGQGLEWMGWMNPNSGNTGYAQKFQGRVTMTRNTSISTAYMXLSSLXSXXTAVYYCAXGFSLTWYFDLWGRGXLVTXSS

SEQ ID NO: 176 - protein, 110 aa, Artificial Sequence
  source: /note="Description of Artificial Sequence: Synthetic polypeptide"
SYELTQPPSVSVAPGKTARITCGGNNIGSKSVHWYQQKPGHAPVLVVYDDSDRPSGIPERFSGSNSGNTATLTISRVEAGDEADYYCQVWDSTGGHPDVVFGGGTKLTVL

SEQ ID NO: 177 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTFSRDNSKNTLYLQMNSLRAEDTAVYYCARDLMAYGMDVWGQGTTVTVSS

SEQ ID NO: 178 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPQGTFGGGTKVEIK

SEQ ID NO: 179 - protein, 117 aa, Artificial Sequence
  source: /note="Description of Artificial Sequence: Synthetic polypeptide"
EVQLVESGGGLVQPGGSLRLSCAASEFTVSSNYMSWVRQAPGKGLEWVSVIYSGGSTFYADSVKGRFTISRDNSKNTLYLQMNSLRPEDTAVYYCARDYGDFYFDFWGQGTLVTVSS

SEQ ID NO: 180 - protein, 107 aa, Artificial Sequence
  source: /note="Description of Artificial Sequence: Synthetic polypeptide"
EIVMTQSPATLSVSPGERATLSCRASQSVSSNLAWYQQKPGQGPRLLIYGASTRATGIPARFSGSGSGTEFTLTISSLQSEDFAVYYCQQYNNWPRTFGQGTKVEIK

SEQ ID NO: 181 - protein, 120 aa, Artificial Sequence
  source: /note="Description of Artificial Sequence: Synthetic polypeptide"
QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCARERYFDLGGMDVWGQGTTVTVSS

SEQ ID NO: 182 - protein, 107 aa, Artificial Sequence
  source: /note="Description of Artificial Sequence: Synthetic polypeptide"
LTQPASVSGSPGQSITISCTGTSSDVGSYNLVSWYQQHPGKAPKLMIYEDSKRPSGVSNRFSGSKSGNTASLTISGLQAEDEADYYCCSYAGSSTRLFGGGTKLTVL

SEQ ID NO: 183 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAAIWYDGSNKHYADSVKGRFTISRDNSKNTLYLQMNSLRAEDTAVYYCARDVGRVTTWFDPWGQGTLVTVSS

SEQ ID NO: 184 - protein, 108 aa, Artificial Sequence
  source: /note="Description of Artificial Sequence: Synthetic polypeptide"
DIQLTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK

SEQ ID NO: 185 - protein, 122 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAITDSGDGTFYADSVKGRFTISRDNSKNTLYLQMNSLRAEDTAVYYCASEEDYSNYVGWFDPWGQGTLVTVSS

SEQ ID NO: 186 - protein, 108 aa, Artificial Sequence; identical to SEQ ID NO: 168
  source: /note="Description of Artificial Sequence: Synthetic polypeptide"

SEQ ID NO: 187 - protein, 122 aa, Artificial Sequence
  source: /note="Description of Artificial Sequence: Synthetic polypeptide"
EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARDRGSSGWYGWYFDLWGRGTLVTVSS

SEQ ID NO: 188 - protein, 108 aa, Artificial Sequence
  source: /note="Description of Artificial Sequence: Synthetic polypeptide"
DIQLTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIK

SEQ ID NO: 189 - DNA, 373 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtatctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaggggagaccatctgatattgtagtggtggtggcctttgactactggggccagggaaccctggtcaccgtctcctcag

SEQ ID NO: 190 - DNA, 322 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaac

SEQ ID NO: 191 - DNA, 352 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccggggacacggccgtgtattactgtgcgagggattacggtgacttctactttgactactggggccagggaaccctggtcaccgtctcctcag

SEQ ID NO: 192 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaggacttttggccaggggaccaagctggagatcaaac

SEQ ID NO: 193 - DNA, 384 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctatcagtggtggcacaaactatgcacagaagtttcagggcagggtcaccatgaccagggacacgtccatcagcacagcctacatggagctgagcaggctgagatctgacgacacggccgtgtattactgtgcgagcccagcatcacgtggatatagtggctacgatcatgggtactactactacatggacgtctggggcaaagggaccacggtcaccgtctcctca

SEQ ID NO: 194 - DNA, 322 bp, Artificial Sequence
  source: /note="Description of Artificial Sequence: Synthetic polynucleotide"
gccatccggatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctatcaccttcggccaagggacacgactggagattaaac

SEQ ID NO: 195 - DNA, 370 bp, Artificial Sequence
  source: /note="Description of Artificial Sequence: Synthetic polynucleotide"
caggtgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggctccccattgtagcggtggtagctgccttgatgcttttgatatctggggccaagggacaatggtcaccgtctcttcag

SEQ ID NO: 196 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagaagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 197 - DNA, 375 bp, Artificial Sequence
  source: /note="Description of Artificial Sequence: Synthetic polynucleotide"
caggtgcagctggtggagtctgggggaggcttggtcaagcctggagggtccctgagactctcctgtgcagcctctggattcatcttcagtgactactgcatgagctggatccgccgggctccagggaaggggctggaatggctttcatatattagtaatagtggtaccaccagatactacgcagactctgtgaagggccgattcaccatctccagggacaacggcaggaactcactgtatctgcaaatggacagcctgagcgccgaagacacggccgtttattactgtgcgagaaggggggacggtagcagctcgatctactactacaactacatggacgtctggggcaaagggaccacggtcaccgtctcctca

SEQ ID NO: 198 - DNA, 331 bp, Artificial Sequence
  source: /note="Description of Artificial Sequence: Synthetic polynucleotide"
cagtctgtgctgactcagccaccctcagcgtctgggacccccggacagagggtcaccgtctcttgttctggaagcagctccaacatcggaagcaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattatttctgtgcagcatgggatgacagcctgaatggtccggtattcggcggagggaccaagctgaccgtcctag

SEQ ID NO: 199 - DNA, 361 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatttcatatgatggaaggaataaatactatgcagactccgtgaagggccgattcaccatctccagagacaactccaagaacacgctgtatctgcaaatgaacagcctgagagctgaggacacggctgtgtattactgtgcgagagaattcggtgaccccgagtggtactttgactactggggccagggaaccctggtcaccgtctcctcag

SEQ ID NO: 200 - DNA, 319 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccaatcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaac

SEQ ID NO: 201 - DNA, 367 bp, Artificial Sequence
  source: /note="Description of Artificial Sequence: Synthetic polynucleotide"
caggtgcagctggtgcagtctggggctgaggtgaagaagcctggggcctcagtgaaggtctcctgcatggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagactccccatttagtgctttaggggcctccaatgactactggggccagggaaccctggtcaccgtctcctcag

SEQ ID NO: 202 - DNA, 331 bp, Artificial Sequence
  source: /note="Description of Artificial Sequence: Synthetic polynucleotide"
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgagtattactgcagctcagatgcaggcagcaacaatgtggtattcggcggagggaccaagctgaccgtcctag

SEQ ID NO: 203 - DNA, 370 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatgctatgcactgggtccgccaggctccagccaaggggctggagtgggtggcagttatattatatgatggaagcggtaaatactacgcagactccgtgaagggccgattcaccatctccagagacaattccaagaacacgttgtatctgcaaatgaacagcctgagagctgaggacacggctgtgtattactgtgcgagagacgggatcgtggatacagctctggttacgtggtttgactactggggccagggaaccctggtcaccgtctcctcag

SEQ ID NO: 204 - DNA, 325 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggagatcaaac

SEQ ID NO: 205 - DNA, 414 bp, Artificial Sequence
  source: /note="Description of Artificial Sequence: Synthetic polynucleotide"
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagggaatcgactactttattgtagtagtaccagctgctatctagatgcggttaggcaggggtactactactactactacatggacgtctggggcaaagggaccacggtcaccgtctcctca

SEQ ID NO: 206 - DNA, 322 bp, Artificial Sequence
  source: /note="Description of Artificial Sequence: Synthetic polynucleotide"
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcccctcactttcggcggagggaccaaggtggagatcaaac

SEQ ID NO: 207 - DNA, 382 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagatatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagtgaccgccccttattgtagtggtggtagctgctacggaggtaactttgactactggggccagggaaccctggtcaccgtctcctcag

SEQ ID NO: 208 - DNA, 322 bp, Artificial Sequence
  source: /note="Description of Artificial Sequence: Synthetic polynucleotide"
gccatccggatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagcggaagtggatctgggacagattttactttcaccatcaacagcctgcagcctgaagatattgcaacatattactgtcaacagtatgataatctccctcctactttcggcggagggaccaaggtggagatcaaac

SEQ ID NO: 209 - DNA, 379 bp, Artificial Sequence
  source: /note="Description of Artificial Sequence: Synthetic polynucleotide"
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtaccataggctatgcggactctgtgaagggccgattcaccatctccagagacaacgccaagaactccctgtatctgcaaatgaacagtctgagagctgaggacacggccttttattactgtgcaaaagcgggcgtaaggggtatagcagcagctggtcccgacctcaacttcgaccactggggccagggaaccctggtcaccgtctcctcag

SEQ ID NO: 210 - DNA, 310 bp, Artificial Sequence
  source: /note="Description of Artificial Sequence: Synthetic polynucleotide"
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtatcaccttcggccaagggacacgactggagattaaac

SEQ ID NO: 211 - DNA, 364 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtaactatgctatacactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattttgacgatagttcgttctgggcgtttgactactggggccagggaaccctggtcaccgtctcctcag

SEQ ID NO: 212 - DNA, 325 bp, Artificial Sequence
  source: /note="Description of Artificial Sequence: Synthetic polynucleotide"
gacatccagttgacccagtctccatcctccctgtctgcgtctgtaggagacagagtcaccatcacttgccgggcaagtcagagcattcgcagctatttaaattggtatcaacagaaaccagggaaagcccctaagctcctgatctatgctgcatccagtttgcaaagtggggtcccttcaaggttcagtggcagtggatctgggacagatttcactctcaccatcagcagtctgcaacctgatgattttgcaacttactactgtcaacagagttacagtacccctccggccacttttggccaggggaccaagctggagatcaaac

SEQ ID NO: 213 - DNA, 361 bp, Artificial Sequence
  source: /note="Description of Artificial Sequence: Synthetic polynucleotide"
caggtgcagctggtgcagtctggggctgaggtgaagaagcctggggcctcagtgaaggtttcctgcaaggcatctggatacaccttcaccagttactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagagtgccccgtgaggggaccccagggttcgacccctggggccagggaaccctggtcaccgtctcctcag

SEQ ID NO: 214 - DNA, 325 bp, Artificial Sequence
  source: /note="Description of Artificial Sequence: Synthetic polynucleotide"
tcctatgagctgacacagccaccctcagtgtcagtggccccaggaaagacggccaggattacctgtggggaaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcaacagggtcgaagccggggatgaggccgactattactgtcaggtgtgggatagtagtagtgatcatgtggtattcggcggagggaccaagctgaccgtcctag

SEQ ID NO: 215 - DNA, 370 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagtttggcaatactatgatagtagtggttcctttgactactggggccagggaaccctggtcaccgtctcctcag

SEQ ID NO: 216 - DNA, 337 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaac

SEQ ID NO: 217 - DNA, 388 bp, Artificial Sequence
  source: /note="Description of Artificial Sequence: Synthetic polynucleotide"
caggtgcagttgcaggagtcgggcccaggactggtgaagccttcggagaccctgtccgtcacttgcactgtctctggtggctccatcagcagtagtaggtactactggggctggatccgccagcccccagggaaggggctggagtggattgggagtatctattatagtgggagcacctactacaacccgtccctcaagagtcgagtcaccatatccgtggacacgtccaagaaccagttctccctgaagctgagctctgtgaccgccgcagacacggctgtgtattactgtgcgagacatgcggcagcatactatgatagaagtggttattatttcatcgaatacttccagcactggggccagggcaccctggtcaccgtctcctcag

SEQ ID NO: 218 - DNA, 322 bp, Artificial Sequence
  source: /note="Description of Artificial Sequence: Synthetic polynucleotide"
gacatccagatgacccagtctccttccaccctgtctgcatctgtaggagacagcgtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataataattaccggtacacttttggccaggggaccaagctggagatcaaac

SEQ ID NO: 219 - DNA, 382 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagcaagtggaatttattgtagtggtggagactgctactcatactactttgactactggggccagggaaccctggtcaccgtctcctcag

SEQ ID NO: 220 - DNA, 319 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaac

SEQ ID NO: 221 - DNA, 370 bp, Artificial Sequence
  source: /note="Description of Artificial Sequence: Synthetic polynucleotide"
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaacaatgtattactatgatagtagtggttcctttgactactggggccagggaaccctggtcaccgtctcctcag

SEQ ID NO: 222 - DNA, 337 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcacactttcggcggagggaccaaggtggagatcaaac

SEQ ID NO: 223 - DNA, 382 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagcaagtggaatatattgtagtggtggtaactgctactcatactactttgactactggggccagggaaccctggtcaccgtctcctcag

SEQ ID NO: 224 - DNA, 319 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtagctggttggcctggtatcagcagaaaccagggaaagcccctaagctcctcatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaac

SEQ ID NO: 225 - DNA, 370 bp, Artificial Sequence
  source: /note="Description of Artificial Sequence: Synthetic polynucleotide"
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagtagggtatgatagtagtggttattcgggctggtacttcgatctctggggccgtggcaccctggtcaccgtctcctcag

SEQ ID NO: 226 - DNA, 325 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagagcattagcagctatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaggtggagatcaaac

SEQ ID NO: 227 - DNA, 358 bp, Artificial Sequence
  source: /note="Description of Artificial Sequence: Synthetic polynucleotide"
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaggggtagcagtggactggtacttcgatctctggggccgtggcaccctggtcaccgtctcctcag

SEQ ID NO: 228 - DNA, 337 bp, Artificial Sequence
  source: /note="Description of Artificial Sequence: Synthetic polynucleotide"
cagtctgtgctgactcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgccctttatgtcttcggaactgggaccaaggtcaccgtcctag

SEQ ID NO: 229 - DNA, 361 bp, Artificial Sequence
  source: /note="Description of Artificial Sequence: Synthetic polynucleotide"
caggtgcagctacagcagtggggcgcaggactgttgaagccttcggagaccctgtcccgcacctgcgctgtctttggtgggtccttcactaattactactggagttggatccgccagtccccagggaaggggctggagtggattggggaaatcaatgatagtggaatcaccaactacaacccgtccctcaagagtcgagtcaccatctcagtagacacgtccaagaaccagttctccctgagcctgaggtctgtgaccgccgcggacacggctgtgtattactgtgccagaaggaggtccttctctcgtccttcgtctatcgactactggggccagggaaccctggtcaccgtctcctcag

SEQ ID NO: 230 - DNA, 334 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatagaaatggatacaactatttggattggtacctgcagaagccagggcagtctccacagctcctgatctatttgggttccaatcgggcctccggggtccctgacaggttcaggggcagtggatcaggcacagatttcacactgaaaatcagcagagtggaggctgaggatgttggggtttattactgcatgcaagctctacaaactctcaccttcggccaagggacacgactggagattaaac

SEQ ID NO: 231 - DNA, 366 bp, Artificial Sequence
  source: /note="Description of Artificial Sequence: Synthetic polynucleotide"
tgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggccccatattgtagtggtggtagctgcaatgatgcttttgatatctggggccaagggacaatggtcaccgtctcttcag

SEQ ID NO: 232 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 233 - DNA, 372 bp, Artificial Sequence
  source: /note="Description of Artificial Sequence: Synthetic polynucleotide"
aggtgcagctggtggagtctgggggaggcgtggtccagcctgggaggtccctgagactctcctgtgcagcctctggattcaccttcaatagaattgccatgtactgggtccgccaggctccaggcaaggggctggaatgggtggcagttatatcatttgatggaagttatgaatactatgcagagtccgtgaagggccggttcgccatctccagagacaattccaagaacacgctgtatctacagatgaacagcctgagagctgaggacacggctgtctattactgtgcgaaaagtccgatgggttattgcactaatggtgtatgctatcctgactcctggggccagggaaccctggtcaccgtctcctcag

SEQ ID NO: 234 - DNA, 333 bp, Artificial Sequence
  source: /note="Description of Artificial Sequence: Synthetic polynucleotide"
aattttatgctgactcagccccactctgtgtcggagtctccggggaagacggttaccatctcctgcaccggcagcagtggcagcattgccagcaactatgtgcagtggtaccagcagcgcccgggcagtgcccccaccactgtgatctatgaagatacccaaagaccctctggggtccctgatcggttctctggctccatcgacagctcctccaattctgcctccctcaccatctctggactgaagactgaggacgaggctgactactactgtcagtcttatgatatcaacagtcgttgggtgttcggcggagggaccaagctgaccgtccta

SEQ ID NO: 235 - DNA, 391 bp, Artificial Sequence
  source: /note="Description of Artificial Sequence: Synthetic polynucleotide"
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatccccattgtagtagtaccagctgccccattttttactactactacatggacgtctggggcaaagggaccacggtcaccgtctcctcag

SEQ ID NO: 236 - DNA, 325 bp, Artificial Sequence
  source: /note="Description of Artificial Sequence: Synthetic polynucleotide"
tcctatgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcagggggtattcggcggagggaccaagctgaccgtcctag

SEQ ID NO: 237 - DNA, 352 bp, Artificial Sequence
  source: /note="Description of Artificial Sequence: Synthetic polynucleotide"
caggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacacagactccgtgaagggccgattcaccatctccagagacaattccaagaacactctgtatcttcaaatgaacagcctgagagccgaggacacggccgtgtattactgtgtgcgggactacggtgacttctactttgactactggggccagggaaccctggtcaccgtctcctcag

SEQ ID NO: 238 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcggtgggtctgagacagacttcactctcaccatcagcagactggagcctgaagattgtgcagtgtattactgtcagcagtatggtagctcaccccggacgttcggccaagggaccaaggtggaaatcaaac

SEQ ID NO: 239 - DNA, 352 bp, Artificial Sequence
  source: /note="Description of Artificial Sequence: Synthetic polynucleotide"
caggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagggactacggtgactactactttgactactggggccagggaaccctggtcaccgtctcctcag

SEQ ID NO: 240 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtctattactgtcagcagtatggtagctcacctcggacgttcggccaagggaccaaggtggaaatcaaac

SEQ ID NO: 241 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccggctacaagccgtccctcaagagtcgagtcaccatatcagtagacatgtccaggaaccagttctccctgaaggtgacctctgtgaccgccgcggacacggctgtgtattactgtgcgagaaagcccctcctctacagtgacttctctcctggtgcttttgatatctggggccaagggacaatggtcaccgtctcttcag

SEQ ID NO: 242 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactgttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatactactacacctcggactttcggcggagggaccaaggtggagatcaaac

SEQ ID NO: 243 - DNA, 370 bp, Artificial Sequence
  source: /note="Description of Artificial Sequence: Synthetic polynucleotide"
caggtgcagctacagcagtggggcgcaggactgttgaagccttcggagaccctgtccctctcctgcgctgtctatggtgggtccctcagtggttactactggagctggatccgccagcccccagggaaggggctggagtggattggggagatcaatcattttggaagcaccggctacaacccgtccctcaagagtcgagtcaccatctccgtggacacgtccaagagccagttctccgtgaagctgagctctgtgaccgccgcggacacggctgtctattactgcgcgagaaagcccctcctctacagtaacttatcccctggtgcttttgatatctggggccaagggacaatggtcaccgtctcttcag

SEQ ID NO: 244 - DNA, 325 bp, Artificial Sequence
  source: /note="Description of Artificial Sequence: Synthetic polynucleotide"
gaaattgtgttgacgcagtctccaggcaccgtgtctttgtctccaggggaaagagccaccctctcctgctgggccagtcagagtgttagcgccagctacttagcctggtaccagcagaaacctggccaggctcccaggctcctcatctatggtgcatccagcagggccactggcatcccagacaggttcagtggcagtgggtctgggacagacttcactctcaccatcagtagactggagcctgaagattttgcagtatattactgtcagcagtacggtactacacctcggactttcggcggagggaccaaggtggagatcaaac

SEQ ID NO: 245 - DNA, 355 bp, Artificial Sequence
  source: /note="Description of Artificial Sequence: Synthetic polynucleotide"
caggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagaggcgaggggtgggagctaccatacgactactggggccagggaaccctggtcaccgtctcctcag

SEQ ID NO: 246 - DNA, 334 bp, Artificial Sequence
  source: /note="Description of Artificial Sequence: Synthetic polynucleotide"
cagtctgccctgactcagcctccctccgcgtccgggtctcctggacagtcagtcaccatctcctgcactggaaccagcagtgacgttggtggttataagtatgtctcctggtaccaacagcacccaggcaaagcccccaaactcatgatttatgaggtcagtaagcggccctcaggggtccctgatcgcttctctggctccaagtctggcaacacggcctccctgaccgtttctgggctccaggctgaggatgaggctgattattactgcagctcatatgaaggcagcaacaattttgtggtattcggcggagggaccaagctgaccgtcctag

SEQ ID NO: 247 - DNA, 397 bp, Artificial Sequence
  source: /note="Description of Artificial Sequence: Synthetic polynucleotide"
cagctgcagctgcaggagtcgggcccaggactggtgaagccttcggagaccctgtccctcacctgcactgtctctggtgcctccgtcagcagtggtagttactactggagctggatccggcagcccccagggaagggactggaatggattgggtatatctattacagtgggagcaccaactacaacccctccctcaagagtcgagtcaccatatcagtggacacgtccaagaaccagttctccctgaagctgagctctgtgaccgctgcggacacggccgtgtattactgtgcgagagagcggcccggtggaacgtatagcaacacctggtacaccccaaccgataccaactggttcgacacctggggccagggaaccctggtcaccgtctcctcag

SEQ ID NO: 248 - DNA, 325 bp, Artificial Sequence
  source: /note="Description of Artificial Sequence: Synthetic polynucleotide"
tcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattttgatagcgaccggccctcagggatccctgagcgattctctggctccaactctgggaacacggccaccctgaccatcagcagggtcgaagccggggatgaggccgactattactgtcaggtgtgggatagtagtcgtgatcatgtggtattcggcggagggaccaagctgaccgtcctag

SEQ ID NO: 249 - DNA, 367 bp, Artificial Sequence
  source: /note="Description of Artificial Sequence: Synthetic polynucleotide"
caggttcagctggtgcagtctggagctgaggtgaagaagcctggggcctcagtgagggtctcctgcaaggcttctggttacacctttaccagctatggtttcagctgggtgcgacaggcccctggacaagggcttgagtggatgggatggatcagcgcttacaatggtaacacaaactttgcacagaagctccagggcagagtcaccatgaccacagacacatccacgagcacagcctacatggagctgaggagcctgagatctgacgacacggccgtgtattactgtgcgagaggggaagcagtggctggtacaaccggtttttttgactactggggccagggaaccctggtcaccgtctcctcag

SEQ ID NO: 250 - DNA, 334 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttttgtggtattcggcggagggaccaagctgaccgtcctag

SEQ ID NO: 251 - DNA, 361 bp, Artificial Sequence
  source: /note="Description of Artificial Sequence: Synthetic polynucleotide"
caggtgcagctgcaggagtcgggcccaggactggtgaagccttcggggaccctgtccctcacctgcgctgtctctggtggctccatcagcagtactaactggtggagttgggtccgccagcccccagggaaggggctggagtggattggggaaatctatcatactgggagcaccaactacaacccgtccctcaagagtcgagtcaccatatcagtagacaagtccaagaaccagttctccctgaagctgagctctgtgaccgccgcggacacggccgtgtattactgtgtgagagatggaggacgacccggggatgcttttgatatctggggccaagggacaatggtcaccgtctcttcag

SEQ ID NO: 252 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcaactcatatacaagcagcagcactcgagtcttcggaactgggaccaaggtcaccgtcctag

SEQ ID NO: 253 - DNA, 385 bp, Artificial Sequence
  source: /note="Description of Artificial Sequence: Synthetic polynucleotide"
caggtacagctgcagcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacatgcagtggagcagcctgaaggcctcggacaccgccatgtattactgtgcgagatcgttccgggacgacccccgtatagcagtggctggcccggctgatgcttttgatatctggggccaagggacaatggtcaccgtctcttcag

SEQ ID NO: 254 - DNA, 322 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagttactggttggcctggtatcagcagaaaccagggaaagcccctaagctcctgatctatcaggcgtctagtttagaaagtggggtcccgtcaaggttcagcggcagtgagtctgggacagaattcactctcaccatcagcagcctgcagcctgatgattttgcaacttattactgccaacagtataatagttacccgtacacttttggccaggggaccaagctggagatcaaac

SEQ ID NO: 255 - DNA, 364 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagccatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagaggattactatgatagtagtggttcttttgactactggggccagggaaccctggtcaccgtctcctcag

SEQ ID NO: 256 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcaccggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtcctag

SEQ ID NO: 257 - DNA, 376 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtaactttggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaggagtaaaccccgacgatattttgactggcgtagatgcttttgatatctggggccaagggacaatggtcaccgtctcttcag

SEQ ID NO: 258 - DNA, 322 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtatgagtagctggttggcctggtatcagcagaaaccagggaacgcccctaagctcctgatctataaggcgtctagtttagaaagtggggtcccatcaaggttcagcggcagtggatctgggacagaattcactctcaccatcagcagcctgcagcctgatgattttgcaacttattactgccaacagcataatagttccccgctcactttcggcggagggaccaaggtggagatcaaac

SEQ ID NO: 259 - DNA, 352 bp, Artificial Sequence
  source: /note="Description of Artificial Sequence: Synthetic polynucleotide"
caggtgcagctggtggagtctggaggagggttgatccagcctggggggtccctgaaactctcctgtgtagtctctgggttcaccgtcagtaagaactacatcagttgggtccgccaggctccaggcaaggggctggaatgggtctcagttatttttgccggtggtagtacattctacgcagactccgttaagggccgattcgccatctccagagacaactccaacaacacgctgtttcttcaaatgaacagcctgagagtcgaggacacggccatttattactgtgcgagaggggacggggagttattctttgaccaatggggccagggaaccctggtcaccgtctcctcag

SEQ ID NO: 260 - DNA, 330 bp, Artificial Sequence
  source: /note="Description of Artificial Sequence: Synthetic polynucleotide"
cagtctgtgctgactcagccgccctcagtgtctggggccccagggcagagggtcaccatctcctgcactgggaccagttccaacatcggggcaggttatgatgtgcactggtaccagcaacttcctggaagagcccccaaagtcctcatctctggaaacaacattcggccctcagaggtccctgaccgattctctggctccaggtctggcacctcagcctccctggccatcactagtctccagcctgaggatgaggctcaatattactgtcagtcttatgacagcagtctctatgcggtgttcggcggagggaccaagctgaccgtccta

SEQ ID NO: 261 - DNA, 361 bp, Artificial Sequence
  source: /note="Description of Artificial Sequence: Synthetic polynucleotide"
caggtgcagctggtggagtctgggggaggcttgataaagccagggcggtccctgagactctcttgtacagcctctggattcacctttggtgattatgctatgacctggttccgccaggctccagggaaggggctggagtgggtaggtttcattagaagtaaagcttatggtgggacaacaggatacgccgcgtctgtgaaatacagatttaccatctcaagagatgattccaaaagcatcgcctatctgcaaatggacagcctgaaaaccgaggacacagccgtgtattactgtactaggtgggacgggtggagtcaacatgactattggggccagggaaccctggtcaccgtctcctcag

SEQ ID NO: 262 - DNA, 337 bp, Artificial Sequence
  source: /note="Description of Artificial Sequence: Synthetic polynucleotide"
gatattgtgatgactcagtctccactctccctgtccgtcacccctggagagccggcctccatctcctgcaggtctagtcagagcctcctgcatagtaatggaaacaactatttcgattggtacctgcagaagccagggcagtctccacagctcctgatctatttgggttctaatcgggcctccggggtccctgacaggttcagtggcagtggatcaggcacagattttacactgaagatcagcagagtggaggctgaggatgttggggtttattactgcatgcaagttctacaaattccgtacacttttggccaggggaccaagctggagatcaaac

SEQ ID NO: 263 - DNA, 355 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcacctacagtacctatgctatgcactgggtccgccaggctccaggcaaggggctggagtgggtggcatttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatttctaccataactggttcgacccctggggccagggaaccctggtcaccgtctcctcag

SEQ ID NO: 264 - DNA, 337 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacaggtcctccaactctgcctccctcaccatctctggactgaagactgaggacgaggctgactactactgtcagtcttatgatagcggcaatcattgggtggtattcggcggagggaccaggctgaccgtcctag

SEQ ID NO: 265 - DNA, 382 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcagttatttcatatgatggaagcaatacatactacgcagactccgtgaagggccgattcaccatctccagagacaattccaagaacacgctgtatctgcaaatgaacagcctgagagctgaagacacggctgtgtattactgtgcgagagatcccatatggttcggggagttattatctcctccttttgttcactttgactactggggccagggaaccctggtcaccgtctcctcag

SEQ ID NO: 266 - DNA, 340 bp, Artificial Sequence
  source: /note="Description of Artificial Sequence: Synthetic polynucleotide"
cagtctgtgctgactcagccgccctcagtgtctgcggccccaggacagaaggtcaccatctcctgctctggaagcagctccaacattgggaataatttggtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggagcatgggatagcagcctgagtgctggcggggtttatgtcttcggaactgggaccaaggtcaccgtcctag

SEQ ID NO: 267 - DNA, 381 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctatttattactgtgcgagtggatatactggctacgattattttgtgcggggggactactacggtctggacgtctggggccaagggaccacggtcaccgtctcctca

SEQ ID NO: 268 - DNA, 334 bp, Artificial Sequence
  source: /note="Description of Artificial Sequence: Synthetic polynucleotide"
cagcctgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacactgatggcagccacagcaagggggacgggatccctgatcgcttctcaggctccagctctggggctgagcgctacctcaccatctccagcctccagtctgaggatgaggctgactattactgtcagacctggggcactggcattctcgtattcggcggagggaccaagctgaccgtcctag

SEQ ID NO: 269 - DNA, 381 bp, Artificial Sequence
  source: /note="Description of Artificial Sequence: Synthetic polynucleotide"
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttacagggcagagtcaccatgaccagggacacgtccacgagcacagtctacatggagctgagcagcctgagatctgaggacacggccgtgtattactgtgcgagagccaatcatgaaacaactatggacacttactactactactactacatggacgtctggggcaaagggaccacggtcaccgtctcctca

SEQ ID NO: 270 - DNA, 334 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggtggttataagtatgtctcctggtaccaacggcacccaggcaaagcccccaaactcatgatatatgatgtcagtaatcggccctcaggggtttctaatcgcttctctggctccaagtctggcaacacggcctccctgaccatctctgggctccaggctgaggacgaggctgattattactgcagctcatacacaagcagcagcacttctgtggtgttcggcggagggacccagctgaccgtcctag

SEQ ID NO: 271 - DNA, 355 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtagcaactacatgacctgggtccgccaggctccagggaaggggctggagtgggtctcacttatttatcccggtggtagcacatactacgcagactccgtgaagggccgattcaccatctccagagacaattccaagaacacgctgtatcttcaaatgaacagcctgagagccgaggacacggccgtctattactgtgcgagagagggtatgggtatggcagcagctggtacgtggggccagggaaccctggtcaccgtctcctcag

SEQ ID NO: 272 - DNA, 322 bp, Artificial Sequence
  source: /note="Description of Artificial Sequence: Synthetic polynucleotide"
gccatccggatgacccagtctccatcctccctgtctgcatctgtaggagacacagtcaccatcacttgccaggcgagtcaggacattagcaagtatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcagactttcggcggagggaccaaggtggagatcaaac

SEQ ID NO: 273 - DNA, 387 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcagccctgtcagtggtggcacaaactatgcacagaagtttcagggcagggtcaccatgaccagggacacgtccatcagcacagcctacatggagctgagcaggctgagatctgacgacacggccgtgtattactgtgcgagagccccactgttccccacaggggtgctagctggggactactactactacggtatggacgtctggggccaagggaccacggtcaccgtctcctca

SEQ ID NO: 274 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctggactccaggctgaggacgaggctgattattactgctgctcatatgcaggtagtagcactttggtattcggcggagggaccaagctgaccgtcctag

SEQ ID NO: 275 - DNA, 358 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggctcaccgtcagtagcaactacatgagctgggtccgccaggctccagggaaggggctggagtgggtctcagttctttatagcggtggtagctcattctacgcagactccgtgaagggccgattcaccatctccagagacaattccaagaacacgctgtatcttcaaatgaacagcctgagagccgaagacacggccgtgtattactgtgcgagagaaagtggggatacaactatggcctttgactactggggccagggaaccctggtcaccgtctcctcag

SEQ ID NO: 276 - DNA, 322 bp, Artificial Sequence
  source: /note="Description of Artificial Sequence: Synthetic polynucleotide"
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagtgactcgtacacttttggccaggggaccaagctggagatcaaac

SEQ ID NO: 277 - DNA, 349 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctggggtcaccgtcagtaggaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatctatctgctgcttttgatatctggggccaagggacaatggtcaccgtctcttcag

SEQ ID NO: 278 - DNA, 322 bp, Artificial Sequence
  source: /note="Description of Artificial Sequence: Synthetic polynucleotide"
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctccagccttcggccaagggacacgactggagattaaac

SEQ ID NO: 279 - DNA, 376 bp, Artificial Sequence
  source: /note="Description of Artificial Sequence: Synthetic polynucleotide"
gaggtgcagctggtggagtctgggggaggcttggtacagcctggggggtccctgagactctcctgtgcagcctctggattcaccttcagtggctatagcatgaactgggtccgccaggctccagggaaggggccggagtgggtttcatacattagtaggagtagtagtaccatatactacgcagactctgtgaagggccgattcaccatctccagagacaatgccaagaactcactgtatctgcaaatgaacagcctgagagacgaggacacggctgtgtattactgtgcgagagaaggggctagagtgggagctacatatgacacgtactactttgactactggggccagggaaccctggtcaccgtctcctcag

SEQ ID NO: 280 - DNA, 328 bp, Artificial Sequence
  source: /note="Description of Artificial Sequence: Synthetic polynucleotide"
gaaattgtgttgacacagtctccagccaccctgtctttgtctccaggggaaagagccaccctctcctgcagggccagtcagagttttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtaacaactggcctcccgagtggacgttcggccaagggaccaaggtggaaatcaaac

SEQ ID NO: 281 - DNA, 370 bp, Artificial Sequence
  source: /note="Description of Artificial Sequence: Synthetic polynucleotide"
caggtgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaccttattgtagtggtggtagctgctctgatgcttttgatatctggggccaagggacaatggtcaccgtctcttcag

SEQ ID NO: 282 - DNA, 325 bp, Artificial Sequence; identical to SEQ ID NO: 232
  source: /note="Description of Artificial Sequence: Synthetic polynucleotide"

SEQ ID NO: 283 - DNA, 355 bp, Artificial Sequence
  source: /note="Description of Artificial Sequence: Synthetic polynucleotide"
caggtgcagctgcaggagtcgggcccaggactggtgaagccttcggagaccctgtccctctcctgcgctgtctctggtggctccatcggtagttacttctggagctggatccggcagcccccagggaagggactggagtggattggatatctccattacagtgggagcaccaactacaacccctccctgaagagtcgagtcaccatatcagtagacacgtccaagaatcagttctccctgaagctgagctctgtgaccgctgcggacacggccgtgtattactgtgcgagattgcagtggctacgcggagcttttgatatctggggccaagggacaatggtcaccgtctcttcag

SEQ ID NO: 284 - DNA, 331 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatcaatgaagataaccaaagaccctctggggtccctgatcggttctctggctccatcgacagctcctccaactctgcctccctcaccatctctggactgaagactgaggacgaggctgactactactgtcagtcttatgatagcagcaatttggtattcggcggagggaccaagctgaccgtcctag

SEQ ID NO: 285 - DNA, 375 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgacggcgcacccccggaggatccaaggggtattttttttggggccgggcgtctggggccaagggaccacggtcaccgtctcctca

SEQ ID NO: 286 - DNA, 331 bp, Artificial Sequence
  source: /note="Description of Artificial Sequence: Synthetic polynucleotide"
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggcgtggtattcggcggagggaccaagctgaccgtcctag

SEQ ID NO: 287 - DNA, 375 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcacctatgccatgagttgggtccgccaggctccagggaaggggctggagtgggtctcaactattactggtagtggtcgtgacacatactacgcagactccgtgaagggccggttcaccatctccagagacaattccaagaacacgctgtttctgcaactgaacagcctgagagccgaggacgcggccgtgtattcctgtgcgaaccaccctctggcatcaggcgacgactactaccactactacatggacgtctggggcaaagggaccacggtcaccgtctcctca

SEQ ID NO: 288 - DNA, 328 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttaacagcaggcagttagcctggtaccagcagaaacctggccaggctcccaggctcctcatctatggtgcgtccagcagggccactggcatcccagagaggttcagtggcagtggatctgggacagacttcactctcaccatcagcagactggagtctgaagattttgcagtgtatcactgtcagcaatatggtagctcaagggcgctcactttcggcggagggaccaaggtggagatcaaac

SEQ ID NO: 289 - DNA, 376 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatggcatgaactgggtccgccaggctccaggcaaggggctggagtgggtggcagttatatcatatgatggaagtaatacatactatacagactccgtgaagggccgattcaccatctccagagacaattccaagaacacgctgtatctgcaaatgaacagcctgagagttgacgacacggctacatattactgtgcgaaagggccccggtttggctggagctatagaggggggtctggttttgatatctggggccaagggacaatggtcaccgtctcttcag

SEQ ID NO: 290 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtgaatctgggacagattttactttcaccatcagcagcctgcagcctgaagatattgcaacatattactgtcaacagtatgataatctcccgatcaccttcggccaagggacacgactggagattaaac

SEQ ID NO: 291 - DNA, 361 bp, Artificial Sequence
  source: /note="Description of Artificial Sequence: Synthetic polynucleotide"
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtggtagcacaggctacgcacagaagttccagggcagagtcaccatgaccagggacacgtccacgagcacagtctacatggagctgagcagcctgagatctgaggacacggccgtgtattactgtgcgagatcccgaccgactcctgactggtacttcgatctctggggccgtggcaccctggtcaccgtctcctcag

SEQ ID NO: 292 - DNA, 331 bp, Artificial Sequence
  source: /note="Description of Artificial Sequence: Synthetic polynucleotide"
tcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccgggggtggtattcggcggagggaccaagctgaccgtcctag

SEQ ID NO: 293 - DNA, 366 bp, Artificial Sequence
  source: /note="Description of Artificial Sequence: Synthetic polynucleotide"
caggtgcagctggtgcagtctgggtctgaggtgaagaagcctgggtcctcggtgaaggtctcctgcaaggcttctggaggcaccttcagcagctatgctttcagctgggtgcgacaggcccctggacaagggcttgagtggatgggaaggatcatccctatccttgctttagcaaactacgcacagaagttccagggcagagtcacgattaccgcggacaaatccacgagcacagcctacatggagctgagcagcctgagatctgaggacacggccgtgtattactgtgcgagagtcaatcaagcagtaactactcccttctccatggacgtctggggccaagggaccacggtcaccgtctcctca

SEQ ID NO: 294 - DNA, 322 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgatcaccttcggccaagggacacgactggagattaaac

SEQ ID NO: 295 - DNA, 367 bp, Artificial Sequence
  source: /note="Description of Artificial Sequence: Synthetic polynucleotide"
caggtgcagctgcaggagtcgggcccaggactggtgaagccttcggggaccctgtccctcacctgcgctgtctctggtggctccatcagcagtaataactggtggagttgtgtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagggggggatacagctatgggccccgaatactttgactactggggccagggaaccctggtcaccgtctcctcag

SEQ ID NO: 296 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcttttgttcggcggagggaccaagctgaccgtcctag

SEQ ID NO: 297 - DNA, 370 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatattatatgatggaagcaataaatactacgcagactccgtgaagggccgattcaccatctccagagacaattccaagaacacgctgtatctgcaaatgaacagcctgagagctgaggacacggctgtgtattactgtgcgagagattcggacgtagatacatctatggttacttggttcgactactggggccagggaaccctggtcaccgtctcctcag

SEQ ID NO: 298 - DNA, 325 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaac

SEQ ID NO: 299 - DNA, 370 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcaactatgccatgagctgggtccgccaggctccagggaaggggctggagtgggtctcagctattagtggtagtgatggtagcacatactacgcaggctccgtgaagggccggttcaccatctccagagacaattccaagaacacactgtatctgcaaatgaacagcctgagagccgaggacacggccgtatattactgtgcgaaagatccccttataactggacctacctatcaatactttcactactggggccagggaaccctggtcaccgtctcctcag

SEQ ID NO: 300 - DNA, 331 bp, Artificial Sequence
  source: /note="Description of Artificial Sequence: Synthetic polynucleotide"
tcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgaatatcactgtcaggtgtgggatagtagtagtgatcgtccgggggtggttttcggcggagggaccaagctgaccgtcctag

SEQ ID NO: 301 - DNA, 358 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttataccatttgatggaagaaataagtactacgcagactccgtgacgggccgattcaccatctccagagacaattccaagaacacactgtatctgcaaatgaacagcctgagagctgaggacacggctgtgtattactgtgcgagtagtagtggttatcttttccactctgactactggggccagggaaccctggtcaccgtctcctcag

SEQ ID NO: 302 - DNA, 322 bp, Artificial Sequence
  source: /note="Description of Artificial Sequence: Synthetic polynucleotide"
gacatccagatgacccagtctccttccaccctgtctgcatctgtaggagacagagtcaccatcacttgccgggccagtcagagtattagtaactggttggcctggtttcagcagaaaccagggaaagcccctaagctcctgatctatgaggcgtctagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggagatcaaac

SEQ ID NO: 303 - DNA, 358 bp, Artificial Sequence
  source: /note="Description of Artificial Sequence: Synthetic polynucleotide"
gaggtgcagctggtggagtctgggggaggcttggtccagcctggggggtccctgagactctcctgtgcagcctctggattcacctttagtacctattggatgagctgggtccgccagcctccagggaaggggctggagtgggtggccaacataaagcaagatggaagtgagaaatactatgtggattctgtgaagggccgattcaccatctccagagacaacgccaagaactcactgtatctgcaaatgaacagcctgagagccgacgacacggccgtgtattactgtgccggggggacatggctacgatcctcttttgactactggggccagggaaccctggtcaccgtctcctcag

SEQ ID NO: 304 - DNA, 330 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtccta

SEQ ID NO: 305 - DNA, 363 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatgccatgcactgggtccgccaggctccaggcaaggggctggagtgggtggcagttatatcatatgatggaagtaataaatactctgcagactccgtgaagggccgattcaccatctccagagacaattccaagaacacgctgtatctgcaaatgaacagcctgagagctgaggacacggctgtgtattactgtgcgaaagggggggcctacagctactactactacatggacgtctggggcaaagggaccacggtcaccgtctcctca

SEQ ID NO: 306 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggaaatcaaac

SEQ ID NO: 307 - DNA, 351 bp, Artificial Sequence
  source: /note="Description of Artificial Sequence: Synthetic polynucleotide"
gaggtgcagctggtggagtctgggggaggcttggtccagcctggggggtccctgagactctcctgtgcagcctctggagtcaccgtcagtagcaactacatgagctgggtccgccaggctccagggaaggggctggagtgggtctcacttatttatagcggtggtagcacattctacgcagactccgtgaagggcagattcaccatctccagagacaattccgagaacacgctgtatcttcaaatgaacaccctgagagccgaggacacggctgtgtattactgtgcgagagatctgtattactacggtatggacgtctggggccaagggaccacggtcaccgtctcctca

SEQ ID NO: 308 - DNA, 322 bp, Artificial Sequence
  source: /note="Description of Artificial Sequence: Synthetic polynucleotide"
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttactcttacacttttggccaggggaccaagctggagatcaaac

SEQ ID NO: 309 - DNA, 372 bp, Artificial Sequence
  source: /note="Description of Artificial Sequence: Synthetic polynucleotide"
gaggtgcagctggtggagtctgggggaggcgtggtccagcctgggaggtccctgagactctcctgtgcagcctctggattcaccttcagtagctatgctatgttctgggtccgccaggctccgggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagggcggatttaggatattgtactaatggtgtatgctatgttgactactggggccagggaaccctggtcaccgtctcctca

SEQ ID NO: 310 - DNA, 331 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctag

SEQ ID NO: 311 - DNA, 388 bp, Artificial Sequence
  source: /note="Description of Artificial Sequence: Synthetic polynucleotide"
gaggtgcagctggtggagtctgggggaggcttggtccagccgggggggtccctgagactctcctgtgcagcctctggattcagtgtcagcaccaagtacatgacatgggtccgtcaggctccagggaaggggctggagtgggtctcagttctttacagcggtggtagtgattactacgcagactccgtgaagggcagattcaccatctccagagacaattccaagaacgctttatatcttcaaatgaacagcttgagagtcgaggacacgggtgtttattactgtgccagagactcgtcggaagtccgtgaccaccccgggcacccagggcgctcggtgggggcttttgatatctggggccaagggacaatggtcaccgtctcttcag

SEQ ID NO: 312 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcaatgatgttgggagttatacccttgtctcctggtaccaacagtacccaggcaaagcccccaaactcttaatttttgagggcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctag

SEQ ID NO: 313 - DNA, 394 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtaacaactacatgagctgggtccgccaggctccagggaaggggctggagtgggtctcagttatttatagcggtggtagcacatactacgcagactccgtgaagggccgattcaccatctccagagacaaatccaagaacacgctgtatcttcaaatgaacaggctgagagccgaggacacggccgtgtattattgtgcgagagaaggggaggtagaagggtataacgatttttggagtggttattctagagaccgttactactttgactactggggccagggaaccctggtcaccgtctcctcag

SEQ ID NO: 314 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcgagtcttcggaactgggaccaaggtcaccgtcctag

SEQ ID NO: 315 - DNA, 394 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcagcgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagagaaggggaggtagaagggtattacgatttttggagtggttattctagagaccgttactactttgactactggggccagggaaccctggtcaccgtctcctcag

SEQ ID NO: 316 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcaccactcgagtcttcggaactgggaccagggtcaccgtcctag

SEQ ID NO: 317 - DNA, 361 bp, Artificial Sequence
  source: /note="Description of Artificial Sequence: Synthetic polynucleotide"
gaggtgcagctggtggagtctgggggaggcctggtcaagcctggggggtccctgagactctcctgtgcagcctctggactcaccttcactgcctatagaatgaattgggtccgccaggctccagggaaggggctggagtggctctcatcaattagtaatacaaatggcgacatatactatgcagactcagtgaagggccgattcaccatctccagagacaacgccaagaattctctgtatctgcaaatgaacagcctgagggccgacgacacggctgtatattactgtgcgagagatgttgcatctaactacgcttactttgacctttggggccagggaaccctggtcaccgtctcctcag

SEQ ID NO: 318 - DNA, 334 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacattggtgtttataactatatctcctggagccaacaacacccaggcaaagcccccaaagtcatgatttatgatgtcactaatcggccctcaggggtttctaatcgcttctctggctccaagtctggcaacacggcctccctgaccatctctgggctccaggctgaggacgaggctgattattattgcagctcatatagaggcagcagcactccctatgtcttcggaactgggaccaaggtcaccgtcctag

SEQ ID NO: 319 - DNA, 361 bp, Artificial Sequence
  source: /note="Description of Artificial Sequence: Synthetic polynucleotide"
gaggtgcagctggtgcagtctggagcagaggtgaaaaagcccggggagtctctgaagatctcctgtaagggttctggatacagatttaccaactactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagactcagtgaccgctggtacagtccgttcgacccctggggccagggaaccctggtcaccgtctcctcag

SEQ ID NO: 320 - DNA, 331 bp, Artificial Sequence
  source: /note="Description of Artificial Sequence: Synthetic polynucleotide"
caggctgtggtgacccaggagccctcactgactgtgtccccaggagggacagtcactctcacctgtggctccagcactggagctgtcaccagtggtcattatccctactggttccagcagaagtctggccaagcccccaggacactgatttatgaaacaagcatcaaacactcctggacccctgcccggttctcaggctccctccttgggggcaaagctgccctgaccctttcgggtgcgcagcctgaggatgaggctgattattactgcttgctctcctatagtggtgctcggccggtgttcggcggagggaccaagctgaccgtcctag

SEQ ID NO: 321 - DNA, 345 bp, Artificial Sequence
  source: /note="Description of Artificial Sequence: Synthetic polynucleotide"
gaggtgcagctggtggagtctgggggaggcttggtccagcctggggggtcccagagactctcctgtgcagcctctggattcaccgtcagtagcaattacatgagctggatccgccaggctccagggaaggggctggagtgggtctcagttatttatagcggtggtagcgcatactacgtagactccgtgaagggcagattcaccatctccagagacaattccaagaacaccctgtatcttcaaatgaacagcctgagacccgaggacacggctgtgtattactgtgcgagaatcgcaaactacatggacgtctggggcaaagggaccacggtcaccgtctcctca

SEQ ID NO: 322 - DNA, 325 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagccacttagcctggtaccagcagaaacctggccaggctcccaggctcctcatctatggtgcatccaccagggccactggtatcccaaccaggttcagtggcagtgggtctgggacagagttcactctcaccatcagcagcctgcagtctgaagattttgcagtttattactgccagcagtataataactggcctccgctcactttcggcggagggaccaaggtggagatcaaac

SEQ ID NO: 323 - DNA, 376 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtacctatggcatgcactgggtccgccaggctccaggcaaggggctggagtgggtggccgttatatcatatgatggaagtaataaatactttgcagactccgtgaagggccgattcaccatctccagagacaattccaagaacacgctttatctgcaaatgaacagcctgagacctgaggacacggctgtatattactgtgcgaaagtggggatggagtacagcagtggctggtacggggaagaaattgacttctggggccagggaaccctggtcaccgtctcctcag

SEQ ID NO: 324 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagagcattagcagttatttaaattggtatcagcagaaaccagggaaagtccctaagctcctgatctatgctgcatccagtttgcaaagtggggtcccatcaaggttcagtggcagtggatctgggacagacttcactctcaccatcagcagtctgcaacctgaagattttgcaacttactactgtcaacagagttacagaaccccgctcactttcggcggagggaccaaggtggagatcaaac

SEQ ID NO: 325 - DNA, 381 bp, Artificial Sequence
  source: /note="Description of Artificial Sequence: Synthetic polynucleotide"
gaggtgcagctggtggagtccgggggaggcttagttcagcctggggggtccctgagactctcctgtgtagcctctggattcaccttcagtagctactggatgcactgggtccgccaagtcccagggaaggggccggtgtgggtctcacatattaacagtgaagggagtagcacaaactacgcggactccgtgaggggccgattcaccatctccagagacaacgccaaggacacgctatatcttcaaatgaacaatctgagagccgaggacacggctgtatattactgtgcaagaccgacggctgtagcagcagctggcaattacttctactactacggtatggacgtctggggccaagggaccacggtcaccgtctcctca

SEQ ID NO: 326 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacgttggttattataactttgtctcctggtaccaacaacacccaggcaaagcccccaaactcatgatttatgaggtcagtaatcggccctctggggtttctaatcgcttctctggctccaagtctggcaacacggcctccctgatcatctctgggctccaggctgaggacgaggctgattattactgcagctcatatagaagcagcagcactctggtgttcggcggggggaccaagctgaccgtcctag

SEQ ID NO: 327 - DNA, 367 bp, Artificial Sequence
  source: /note="Description of Artificial Sequence: Synthetic polynucleotide"
gaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatgcattagtagtagtagtagttacatatactacgcagactcagtgaagggccgattcaccatctccagagacaacgccaagaactcactgtatctgcaaatgaacagcctgagagccgaggacacggctgtgtattactgtgcgagagagagggggtatgacggtggtaaaacccccccatttcttgggggccagggaaccctggtcaccgtctcctcag

SEQ ID NO: 328 - DNA, 334 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattattgggtgttcggcggagggaccaagctgaccgtcctag

SEQ ID NO: 329 - DNA, 390 bp, Artificial Sequence
  source: /note="Description of Artificial Sequence: Synthetic polynucleotide"
caggttcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgttttactgtgcgagagatcggggggggcacgatttttggagtggttatgggttctactactactacggtatggacgtctggggccaagggaccacggtcaccgtctcctca

SEQ ID NO: 330 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcgagtcagggcataagcaattacttagcctggtatcagcagagaccagggaaagttcctaagctcctgatctttgctgcatccactttgcaatcaggggtcccatctcggttcagtggcagtggatctgggacagatttcactctcaccatcagcagcctgcagcctgaagatgttgcaacttattactgtcaaaagtataacagtgcccctcggacgttcggccaagggaccaaggtggaaatcaaac

SEQ ID NO: 331 - DNA, 367 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggttatagcacatactacgtagactccgtgaagggccgattcaccatctccagagacaattccaagaacacgctgtatcttcaaatgaacagcctgagagccgaggacacggccgtgtattactgtgcgagagtggggggagcacatagtggctacgacggatcctttgactactggggccagggaaccctggtcaccgtctcctcag

SEQ ID NO: 332 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttgggtgttcggcggagggaccaagctgaccgtcctag

SEQ ID NO: 333 - DNA, 382 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtcgctatggcatgcactgggtccgccaggctccaggcaaggggctggagtgggtggcagttatgtcatatgatggaagtagtaaatactatgcagactccgtgaagggccgattcaccatctccagagacaattccaagaacacgctgtgtctgcaaatgaacagcctgagagctgaggacacggctgtgtattactgtgcgaaacaggcgggcccatattgtagtggtggtagctgctactccgcgccctttgactactggggccagggaaccctggtcaccgtctcctcag

SEQ ID NO: 334 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcagggcattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaac

SEQ ID NO: 335 - DNA, 352 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcatcgtcagtagcaactacatgagctgggtccgccaggctccagggaagggcctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagagattttggagagttctactttgactactggggccagggaaccctggtcaccgtctcctcag

SEQ ID NO: 336 - DNA, 322 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactgctatcccagccaggttcagtggcagtgggtctgggacagagttcactctcaccatcagcagcctgcagtctgaagattttgcagtttattactgtcagcagtataataactggcctcggacgttcggccaagggaccaaggtggagatcaaac

SEQ ID NO: 337 - DNA, 373 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatatgatggaaataataaatactatgcagactccgtgaagggccgattcaccatctccagagacaattccaagaacacgctgtatctgcaaatgaacagcctgagagctgaggacacggctgtgtattactgtgcgaaagatcctttccccttagcagtggctgggacgggctactttgactactggggccagggaaccctggtcaccgtctcctcag

SEQ ID NO: 338 - DNA, 325 bp, Artificial Sequence
  source: /note="Description of Artificial Sequence: Synthetic polynucleotide"
tcctatgagctgactcagccaccctcggtgtcagtggccccaggacagacggccaggatttcctgtgggggaaacaacattggaagtaaaaatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatccttgggtgttcggcggagggaccaagctgaccgtcctag

SEQ ID NO: 339 - DNA, 381 bp, Artificial Sequence
  source: /note="Description of Artificial Sequence: Synthetic polynucleotide"
caggttcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagttcccgcctcgtacggtgacgacgattactactactactacggtatggacgtctggggccaagggaccacggtcaccgtctcctca

SEQ ID NO: 340 - DNA, 325 bp, Artificial Sequence
  source: /note="Description of Artificial Sequence: Synthetic polynucleotide"
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtactctttgggtgttcggcggagggaccaagctgaccgtcctag

SEQ ID NO: 341 - DNA, 370 bp, Artificial Sequence
  source: /note="Description of Artificial Sequence: Synthetic polynucleotide"
caggtgcagctacagcagtggggcgcaggactgttgaagccttcggagaccctgtctctcacctgcgctgtctctggtgggtcactcagtggtttctactggacctggatccgccagccccccggaaaggggctggagtggattggggaaaccaatcattttggaagcaccgactacaagccgtccctcaagagtcgagtcaccatatcagtagacatgtccaggaaccaattttccctgattatgacctctgtgaccgccgcggacacggctgtgtattactgtgcgagaaagaccctcctcttcagtgacttttctcctggtgcttttgatatctggggccaagggacaatggtcaccgtctcttcag

SEQ ID NO: 342 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactcttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatggtactacacctcggactttcggcggagggaccaaggtggaaatcaa

SEQ ID NO: 343 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaaggcgtccctcaagagtcgagtcaccatatcagtaggcatgtccaggaaccaattttccctgaaggtgacttctctgaccgccgcggacacggctgtgtattactgcgcgagaaagcccctcctctacagtgacttttctcctggtgcttttgatgtctggggccaagggacaatggtcaccgtctcttcag

SEQ ID NO: 344 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactcttaccgccaactacttagcctggtaccagcagaaacctggccaggctcccagactcctcatctatggtgcatccaagagggccgctggcatcccagacaggttcagtggcagtgggtctgggacagacttcactctcagcatcaccagactggagcctgaagattttgcagtgtattactgtcagcagtatcatactacacctcggactttcggcggagggaccaaggtggagatcaa

SEQ ID NO: 345 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaagccgtccctcaagagtcgagtcaccatatcagtagacatgtccaggaaccagttctccctgaaggtgacctctgtgaccgccgcggacacggctgtttattactgtgcgagaaagcccctcctccacagtgacttatctcctggtgcttttgatatctggggccaagggacaatggtcaccgtctcttcag

SEQ ID NO: 346 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactgtttccgccaactacttagcctggtaccagcagaaagctggccaggctcccagactcctcatctatggtgcatccaagagggccactggcatcccagacaggttcagtggcagtgggtctgggacagacttcactctcagcatcagcagactggagcctgaagattttgctgtgtattactgtcagcagtatgttactacacctcggactttcggcggagggaccaaggtggaaatcaa

SEQ ID NO: 347 - DNA, 388 bp, Artificial Sequence; identical to SEQ ID NO: 311
  source: /note="Description of Artificial Sequence: Synthetic polynucleotide"

SEQ ID NO: 348 - DNA, 331 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcaatgatgttgggagttatacccttgtctcctggtaccaacagtacccaggcaaagcccccaagctcttaatttttgaggtcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctag

SEQ ID NO: 349 - DNA, 367 bp, Artificial Sequence
  source: /note="Description of Artificial Sequence: Synthetic polynucleotide"
caggtgcagctggtgcagtctggggctgaggtgaagaagcctgggtcgtcggtgaaggtctcctgcaaggcttctggaggcaccttcagtagctatgctatcaactgggtgcgacaggcccctggacaagggcttgagtggatgggaaggatcatccctatcgttggtatagcaaactacgcacagaagttccagggcagagtcacgattacggcggacaaatcctcgagcacagcctacatggagctgagcagcctgagatctgaggacacggccgtgtattactgtgcgagagatctcctggacccccagctagatgatgcttttgatatctggggccaagggacaatggtcaccgtctcttcag

SEQ ID NO: 350 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 351 - DNA, 364 bp, Artificial Sequence
  source: /note="Description of Artificial Sequence: Synthetic polynucleotide"
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtataggctatgcggactctgtgaagggccgattcaccatctccagagacaacgccaagaactccctgtatctgcaaatgaacagtctgagagctgaggacacggccttgtattactgtgtaaaaggggtcgagtatagcagctcgagcaactttgactactggggccagggaaccctggtcaccgtctcctcag

SEQ ID NO: 352 - DNA, 320 bp, Artificial Sequence
  source: /note="Description of Artificial Sequence: Synthetic polynucleotide"
catccggatgacccagtctccatcttctgtgtctgcatctgtaggagacagagtcaccatcacttgtcgggcgagtcagggtattagcagctggttagcctggtatcagcagaaaccagggaaagcccctaagctcctgatctatgttgaatccagtttgcaaagtggggtcccatcaaggttcagcggcagtggatctgggacagatttcactctcactatcagcagcctgcagcctgaagattttgcaacctactattgtcaacaggctaacagtttccctctcactttcggcggagggaccaaggtggaaatcaaac

SEQ ID NO: 353 - DNA, 352 bp, Artificial Sequence
  source: /note="Description of Artificial Sequence: Synthetic polynucleotide"
gaggtgcagctggtggagtctgggggaggcttggtccagcctggggggtccctaagactctcctgtgcagcctctggattcaccgtcagtagcaactacatgagctgggtccgccaggctccagggaaggggctggagtgggtctcacttatttatagcggtggtagcacatactacgcagactccgtgaagggccgattcaccatctccagagacaattccaagaacacgctgtatcttcaaatgaacagcctgagagctgaggacacggctgtgtattactgtgcgagagatacccttggtagggggggcgactactggggccagggaaccctggtcaccgtctcctcag

SEQ ID NO: 354 - DNA, 322 bp, Artificial Sequence
  source: /note="Description of Artificial Sequence: Synthetic polynucleotide"
gacatccagttgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcggagttttggccaggggaccaagctggagatcaaac

SEQ ID NO: 355 - DNA, 379 bp, Artificial Sequence
  source: /note="Description of Artificial Sequence: Synthetic polynucleotide"
gaggtgcagctgttggagtctgggggaggcttggaacagcctggggggtccctgagactctcctgtgcagcctctggattcacttttagcacctatgccatgagctgggtccgccaggctccagggaaggggctggagtgggtctcagctattagtggtagtggtgctggcacattctacgcagactccgtgaagggccggttcaccatctccagagacaattccaagaacacgctgtatctgcaaatgaacagcctgagagccgaggacacggccgtatattactgtgcgagagagagcgattgtggtagtaccagctgctatcaagtcgggtggttcgacccctggggccagggaaccctggtcaccgtctcctcag

SEQ ID NO: 356 - DNA, 325 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaggggaccaaggtggaaatcaaac

SEQ ID NO: 357 - DNA, 373 bp, Artificial Sequence
  source: /note="Description of Artificial Sequence: Synthetic polynucleotide"
caggtgcagctggtgcagtctggggctgaggtgaagaagcctggggcctcagtgaaggtttcctgcaaggcatctggacacaccttcaccagctactatatgcactgggtgcgacaggcccctggacaagggcttgagtggatgggaatcatcaaccctagtggtggtagcacaagctacgcacagaagttccagggcagagtcaccatgaccagggacacgtccacgagcacagtctacatggagctgagcagcctgagatctgaggacacggctgtgtattactgtgctagggggccggaacggggtatagtgggagctactgactactttgactactggggccagggaaccctggtcaccgtctcctcag

SEQ ID NO: 358 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgttagctcaccgtggacgttcggccaagggaccaaggtggagatcaaac

SEQ ID NO: 359 - DNA, 364 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaacccatcggccagccactgctatggtgggactactggggccagggaaccctggtcaccgtctcctcag

SEQ ID NO: 360 - DNA, 322 bp, Artificial Sequence
  source: /note="Description of Artificial Sequence: Synthetic polynucleotide"
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccccgggggttcggccaagggaccaaggtggagatcaaac

SEQ ID NO: 361 - DNA, 358 bp, Artificial Sequence
  source: /note="Description of Artificial Sequence: Synthetic polynucleotide"
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgaagtggagcagcctgaaggcctcggacagcgccatgtattactgtgcgagggggcccaacctccagaactggttcgacccctggggccagggaaccctggtcaccgtctcctcag

SEQ ID NO: 362 - DNA, 322 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagagtgttagcggcagctacttagcctggtaccagcagagacctggccaggctcccaggctcctcatctatggtgcttccagcagggccactggcatcccagacaggttcagtggcagtgggtctgggacagacttcactctcaccatcagcagactggagcctgaagattttgcagtgtattactgtcagcagtatggtagctcgctcactttcggcggggggaccaaggtggagatcaaac

SEQ ID NO: 363 - DNA, 358 bp, Artificial Sequence
  source: /note="Description of Artificial Sequence: Synthetic polynucleotide"
  modified_base (246)..(246): a, c, t, g, unknown or other
  modified_base (260)..(260): a, c, t, g, unknown or other
  modified_base (267)..(267): a, c, t, g, unknown or other
  modified_base (270)..(270): a, c, t, g, unknown or other
  modified_base (293)..(293): a, c, t, g, unknown or other
  modified_base (336)..(337): a, c, t, g, unknown or other
  modified_base (350)..(350): a, c, t, g, unknown or other
caggtgcagctggtgcagtctggggctgaggtgaagaagtctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatgganctgagcagcctganatctganganacggccgtgtattactgtgcganagggttcagcctgacttggtacttcgatctctggggccgtggnnccctggtcaccgnctcctcag

SEQ ID NO: 364 - DNA, 331 bp, Artificial Sequence
  source: /note="Description of Artificial Sequence: Synthetic polynucleotide"
tcctatgagctgacacagccaccctcggtgtcagtggccccaggaaagacggccaggattacctgtgggggaaacaacattggaagcaaaagtgtgcactggtaccagcagaagccaggccatgcccctgtactggtcgtctatgatgatagcgaccggccctcagggatccctgagcgattctctggctccaactctgggaacacggccaccctgaccatcagcagggtcgaagccggggatgaggccgactattactgtcaggtgtgggatagtactggtggtcatcccgatgtggtgttcggcggagggaccaagctgaccgtcctag

SEQ ID NO: 365 - DNA, 352 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagtacattctacgcagactccgtgaagggccgattcaccttctccagagacaattccaagaacacgctgtatcttcaaatgaacagcctgagagccgaggacacggccgtgtattactgtgcgagagatttgatggcctacggtatggacgtctggggccaagggaccacggtcaccgtctcctcag

SEQ ID NO: 366 - DNA, 325 bp, Artificial Sequence
  source: /note="Description of Artificial Sequence: Synthetic polynucleotide"
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcagggcactttcggcggagggaccaaggtggaaatcaaac

SEQ ID NO: 367 - DNA, 352 bp, Artificial Sequence
  source: /note="Description of Artificial Sequence: Synthetic polynucleotide"
gaggtgcagctggtggagtctgggggaggcttggtccagcctggggggtccctgagactctcctgtgcagcctctgaattcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagacctgaggacacggctgtgtattactgtgcgagagactacggtgacttctactttgacttctggggccagggaaccctggtcaccgtctcctcag

SEQ ID NO: 368 - DNA, 322 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccagggtcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccccggacgttcggccaagggaccaaggtggagatcaaac

SEQ ID NO: 369 - DNA, 361 bp, Artificial Sequence
  source: /note="Description of Artificial Sequence: Synthetic polynucleotide"
caggtgcagctggtgcagtctggggctgaggtgaagaagcctggggcctcagtgaaggtctcctgcaaggcttctggatacaccgtcaccggctattatatacactgggtgcgacaggcccctggacaagggcttgagtggatgggatggatcagccctaacagtggtggcacaaactatgcacagaagtttcagggctgggtcaccatgaccagggacatgtccatcaccacagcctacatggagctgagtagactgagatctgacgacacggccgtgtattactgtgcgagggaacgatattttgacttgggtggtatggacgtctggggccaagggaccacggtcaccgtctcctcag

SEQ ID NO: 370 - DNA, 322 bp, Artificial Sequence
  source: /note="Description of Artificial Sequence: Synthetic polynucleotide"
ctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcaggtagtagcactcggctattcggcggagggaccaagctgaccgtcctag

SEQ ID NO: 371 - DNA, 361 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagctatatggtatgatggaagtaataaacactatgcagactccgtgaagggccgattcaccatctccagagacaattccaagaacacgctgtatctgcaaatgaacagcctgagagccgaggacacggctgtgtattactgtgcgagagatgtagggcgggtgacgacctggttcgacccctggggccagggaaccctggtcaccgtctcctcag

SEQ ID NO: 372 - DNA, 325 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcagctatttaacttggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggagatcaaac

SEQ ID NO: 373 - DNA, 367 bp, Artificial Sequence
  source: /note="Description of Artificial Sequence: Synthetic polynucleotide"
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattactgatagtggtgatggcacattctacgcagactccgtgaagggccggttcaccatctccagagacaattccaagaacacgctgtatctgcaaatgaacagcctgagagccgaggacacggccgtttattactgtgcgtccgaagaggactacagtaactacgtggggtggttcgacccctggggccagggaaccctggtcaccgtctcctcag

SEQ ID NO: 374 - DNA, 325 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctacaacctgaagattttgcaacttactactgtcaacagagttacagtacccctccgtggacgttcggccaagggaccaaggtggaaatcaaac

SEQ ID NO: 375 - DNA, 367 bp, Artificial Sequence
  source: /note="Description of Artificial Sequence: Synthetic polynucleotide"
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccagactccgtgaagggccgattcaccatctccagagaaaatgccaagaactccttgtatcttcaaatgaacagcctgagagccggggacacggctgtgtattactgtgcaagagatcggggaagcagtggctggtacggctggtacttcgatctctggggccgtggcaccctggtcaccgtctcctcag

SEQ ID NO: 376 - DNA, 325 bp, Artificial Sequence
  source: /note="Description of Artificial Sequence: Synthetic polynucleotide"
gacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtacccccccgatcaccttcggccaagggacacgactggagattaaac

SEQ ID NO: 377 - protein, 120 aa, Artificial Sequence
  source: /note="Description of Artificial Sequence: Synthetic polypeptide"
EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVTVSS

SEQ ID NO: 378 - protein, 13 aa, Artificial Sequence
  source: /note="Description of Artificial Sequence: Synthetic peptide"
TRDDSSWPHFFDN

SEQ ID NO: 379 - protein, 107 aa, Artificial Sequence
  source: /note="Description of Artificial Sequence: Synthetic polypeptide"
DIQMTQSPSSLSAFVGDRVTITCRASQSVANYLNWYQQKPGKAPKLLIYSASSLQSGVPSRFSGSGSGTDFSLTISSLQPEDTATYYCQQSFITPWTFGQGTKVEIK

SEQ ID NO: 380 - protein, 9 aa, Artificial Sequence
  source: /note="Description of Artificial Sequence: Synthetic peptide"
QQSFITPWT

SEQ ID NO: 381 - protein, 120 aa, Artificial Sequence
  source: /note="Description of Artificial Sequence: Synthetic polypeptide"
EVQLVESGGGLVQPGGSLRLSCAASGFNFSTHWMHWVRQAPGKGLVWVSRISSDGSRRAYATSVKGRFTISRDNAKNTLYLQMDSLRDDDTAVYYCTRDDSSWPHFFDNWGQGTLVTVSS

SEQ ID NO: 382 - protein, 13 aa, Artificial Sequence
  source: /note="Description of Artificial Sequence: Synthetic peptide"
TRDDSSWPHFFDN

SEQ ID NO: 383 - protein, 107 aa, Artificial Sequence
  source: /note="Description of Artificial Sequence: Synthetic polypeptide"
DIQMTQSPSSLSAFVGDRVTITCRASQSVANYLNWYQQKPGKAPKLLIYSASSLQSGVPSRFSGGGSGTDFSLTISSLQPEDTATYYCQQSFITPWTFGQGTKVEIK

SEQ ID NO: 384 - protein, 9 aa, Artificial Sequence
  source: /note="Description of Artificial Sequence: Synthetic peptide"
QQSFITPWT

SEQ ID NO: 385 - protein, 120 aa, Artificial Sequence; identical to SEQ ID NO: 377
  source: /note="Description of Artificial Sequence: Synthetic polypeptide"

SEQ ID NO: 386 - protein, 13 aa, Artificial Sequence
  source: /note="Description of Artificial Sequence: Synthetic peptide"
TRDDSSWPHFFDN

SEQ ID NO: 387 - protein, 107 aa, Artificial Sequence; identical to SEQ ID NO: 379
  source: /note="Description of Artificial Sequence: Synthetic polypeptide"

SEQ ID NO: 388 - protein, 9 aa, Artificial Sequence
  source: /note="Description of Artificial Sequence: Synthetic peptide"
QQSFITPWT

SEQ ID NO: 389 - protein, 120 aa, Artificial Sequence; identical to SEQ ID NO: 381
  source: /note="Description of Artificial Sequence: Synthetic polypeptide"

SEQ ID NO: 390 - protein, 13 aa, Artificial Sequence
  source: /note="Description of Artificial Sequence: Synthetic peptide"
TRDDSSWPHFFDN

SEQ ID NO: 391 - protein, 107 aa, Artificial Sequence; identical to SEQ ID NO: 383
  source: /note="Description of Artificial Sequence: Synthetic polypeptide"

SEQ ID NO: 392 - protein, 9 aa, Artificial Sequence
  source: /note="Description of Artificial Sequence: Synthetic peptide"
QQSFITPWT

SEQ ID NO: 393 - protein, 120 aa, Artificial Sequence; identical to SEQ ID NO: 377
  source: /note="Description of Artificial Sequence: Synthetic polypeptide"

SEQ ID NO: 394 - protein, 13 aa, Artificial Sequence
  source: /note="Description of Artificial Sequence: Synthetic peptide"
TRDDSSWPHFFDN

SEQ ID NO: 395 - protein, 107 aa, Artificial Sequence; identical to SEQ ID NO: 379
  source: /note="Description of Artificial Sequence: Synthetic polypeptide"

SEQ ID NO: 396 - protein, 9 aa, Artificial Sequence
  source: /note="Description of Artificial Sequence: Synthetic peptide"
QQSFITPWT

SEQ ID NO: 397 - protein, 120 aa, Artificial Sequence; identical to SEQ ID NO: 381
  source: /note="Description of Artificial Sequence: Synthetic polypeptide"

SEQ ID NO: 398 - protein, 13 aa, Artificial Sequence
  source: /note="Description of Artificial Sequence: Synthetic peptide"
TRDDSSWPHFFDN

SEQ ID NO: 399 - protein, 107 aa, Artificial Sequence; identical to SEQ ID NO: 383
  source: /note="Description of Artificial Sequence: Synthetic polypeptide"

SEQ ID NO: 400 - protein, 9 aa, Artificial Sequence
  source: /note="Description of Artificial Sequence: Synthetic peptide"
QQSFITPWT

SEQ ID NO: 401 - protein, 120 aa, Artificial Sequence
  source: /note="Description of Artificial Sequence: Synthetic polypeptide"
EVQLVESGGGLVQPGGSLRLSCAASGFNFSTHWMHWVRQAPGKGLVWVSRINSDGSRRAYATSVKGRFTISRDNAKNTLYLQMDSLRDEDTAVYFCTRDDSSWPHFFDNWGQGTLVTVSS

SEQ ID NO: 402 - protein, 13 aa, Artificial Sequence
  source: /note="Description of Artificial Sequence: Synthetic peptide"
TRDDSSWPHFFDN

SEQ ID NO: 403 - protein, 107 aa, Artificial Sequence
  source: /note="Description of Artificial Sequence: Synthetic polypeptide"
DIQMTQSPSSLSASVGDRVTITCRASQSVANYLNWYQQKPGKAPKLLIYSASSLQSGVPSRFSGSGSGTDFSLTISSLQPEDTATYYCQQSFITPWTFGQGTKVEIK

SEQ ID NO: 404 - protein, 9 aa, Artificial Sequence
  source: /note="Description of Artificial Sequence: Synthetic peptide"
QQSFITPWT

SEQ ID NO: 405 - protein, 120 aa, Artificial Sequence
  source: /note="Description of Artificial Sequence: Synthetic polypeptide"
EVQLVESGGGLVQPGGSLRLSCAASGFNFSTHWMHWVRQAPGKGLVWVSRINTDGSRRAYATSVKGRFTISRDNAKNTVHLQMDSLRDEDTAVYFCTRDDSSWPHFFDNWGQGTLVTVSS

SEQ ID NO: 406 - protein, 13 aa, Artificial Sequence
  source: /note="Description of Artificial Sequence: Synthetic peptide"
TRDDSSWPHFFDN

SEQ ID NO: 407 - protein, 107 aa, Artificial Sequence; identical to SEQ ID NO: 403
  source: /note="Description of Artificial Sequence: Synthetic polypeptide"

SEQ ID NO: 408 - protein, 9 aa, Artificial Sequence
  source: /note="Description of Artificial Sequence: Synthetic peptide"
QQSFITPWT

SEQ ID NO: 409 - protein, 120 aa, Artificial Sequence; identical to SEQ ID NO: 381
  source: /note="Description of Artificial Sequence: Synthetic polypeptide"

SEQ ID NO: 410 - protein, 13 aa, Artificial Sequence
  source: /note="Description of Artificial Sequence: Synthetic peptide"
TRDDSSWPHFFDN

SEQ ID NO: 411 - protein, 107 aa, Artificial Sequence; identical to SEQ ID NO: 383
  source: /note="Description of Artificial Sequence: Synthetic polypeptide"

SEQ ID NO: 412 - protein, 9 aa, Artificial Sequence
  source: /note="Description of Artificial Sequence: Synthetic peptide"
QQSFITPWT

SEQ ID NO: 413 - protein, 120 aa, Artificial Sequence; identical to SEQ ID NO: 405
  source: /note="Description of Artificial Sequence: Synthetic polypeptide"

SEQ ID NO: 414 - protein, 13 aa, Artificial Sequence
  source: /note="Description of Artificial Sequence: Synthetic peptide"
TRDDSSWPHFFDN

SEQ ID NO: 415 - protein, 107 aa, Artificial Sequence; identical to SEQ ID NO: 403
  source: /note="Description of Artificial Sequence: Synthetic polypeptide"

SEQ ID NO: 416 - protein, 9 aa, Artificial Sequence
  source: /note="Description of Artificial Sequence: Synthetic peptide"
QQSFITPWT

SEQ ID NO: 417 - protein, 120 aa, Artificial Sequence; identical to SEQ ID NO: 377
  source: /note="Description of Artificial Sequence: Synthetic polypeptide"

SEQ ID NO: 418 - protein, 13 aa, Artificial Sequence
  source: /note="Description of Artificial Sequence: Synthetic peptide"
TRDDSSWPHFFDN

SEQ ID NO: 419 - protein, 107 aa, Artificial Sequence
  source: /note="Description of Artificial Sequence: Synthetic polypeptide"
DIQMTQSPSSLSASVGDRVTITCRASQSVANYLNWYQKKPGKAPKLLIYSASSLQSGVPSRFSGSGSGTDFSLTISSLQPEDTATYYCQQSFITPWTFGQGTKVEIK

SEQ ID NO: 420 - protein, 9 aa, Artificial Sequence
  source: /note="Description of Artificial Sequence: Synthetic peptide"
QQSFITPWT

SEQ ID NO: 421 - protein, 120 aa, Artificial Sequence; identical to SEQ ID NO: 381
  source: /note="Description of Artificial Sequence: Synthetic polypeptide"

SEQ ID NO: 422 - protein, 13 aa, Artificial Sequence
  source: /note="Description of Artificial Sequence: Synthetic peptide"
TRDDSSWPHFFDN

SEQ ID NO: 423 - protein, 107 aa, Artificial Sequence; identical to SEQ ID NO: 383
  source: /note="Description of Artificial Sequence: Synthetic polypeptide"

SEQ ID NO: 424 - protein, 9 aa, Artificial Sequence
  source: /note="Description of Artificial Sequence: Synthetic peptide"
QQSFITPWT

SEQ ID NO: 425 - protein, 120 aa, Artificial Sequence; identical to SEQ ID NO: 401
  source: /note="Description of Artificial Sequence: Synthetic polypeptide"

SEQ ID NO: 426 - protein, 13 aa, Artificial Sequence
  source: /note="Description of Artificial Sequence: Synthetic peptide"
TRDDSSWPHFFDN

SEQ ID NO: 427 - protein, 107 aa, Artificial Sequence; identical to SEQ ID NO: 403
  source: /note="Description of Artificial Sequence: Synthetic polypeptide"

SEQ ID NO: 428 - protein, 9 aa, Artificial Sequence
  source: /note="Description of Artificial Sequence: Synthetic peptide"
QQSFITPWT

SEQ ID NO: 429 - protein, 125 aa, Artificial Sequence
  source: /note="Description of Artificial Sequence: Synthetic polypeptide"
EVQLVESGGGLVQPGGSLRLSCAASGFTFSNYDMHWVRQVTGEGLEWVSAIGTAGDTYYPGSVKGRFTISRENAKNSVFLQMNSLRAGDTAVYYCARGRGHCSSISCLHSWFDSWGQGTLVTVSS

SEQ ID NO: 430 - protein, 19 aa, Artificial Sequence
  source: /note="Description of Artificial Sequence: Synthetic peptide"
ARGRGHCSSISCLHSWFDS

SEQ ID NO: 431 - protein, 109 aa, Artificial Sequence
  source: /note="Description of Artificial Sequence: Synthetic polypeptide"
QSVLTQPPSVSGAPGQRVTISCTGSSSNIGAGSDVHWYQKLPGIAPKVLIYGYSNRPSGVPDRFSGSKSGTSASLAITGLQAEDEADYYCQSYDTSLRVVFGGGTKLTV

SEQ ID NO: 432 - protein, 10 aa, Artificial Sequence
  source: /note="Description of Artificial Sequence: Synthetic peptide"
QSYDTSLRVV

SEQ ID NO: 433 - protein, 125 aa, Artificial Sequence
  source: /note="Description of Artificial Sequence: Synthetic polypeptide"
EVQLVESGGGLVQPGGSLRLSCAASGFTFSNYDMHWVRQATGEGLEWVSAIGTAGDTYYPGSVKGRFTISRENAKNSVFLQMNSLRAGDTAVYYCARGRGHCSSISCLHSWFDSWGQGTLVTVSS

SEQ ID NO: 434 - protein, 19 aa, Artificial Sequence
  source: /note="Description of Artificial Sequence: Synthetic peptide"
ARGRGHCSSISCLHSWFDS

SEQ ID NO: 435 - protein, 109 aa, Artificial Sequence
  source: /note="Description of Artificial Sequence: Synthetic polypeptide"
QSVLTQPPSVSGAPGQRVTISCTGSSSNIGAGSDVHWYQKLPGTAPKVLIYGYSNRPSGVPDRFSGSKSGTSASLAITGLQAEDEADYYCQSYDTSLRVVFGGGTKLTV

SEQ ID NO: 436 - protein, 10 aa, Artificial Sequence
  source: /note="Description of Artificial Sequence: Synthetic peptide"
QSYDTSLRVV

SEQ ID NO: 437 - protein, 125 aa, Artificial Sequence
  source: /note="Description of Artificial Sequence: Synthetic polypeptide"
EVQLVESGGGLIQPGGSLRLSCAASGFTFNNYDIHWVRQATGEGLEWVSAIGTAGDTYYPGSVKGRFTISRENAKNSVFLQMNSLRAGDTAVYYCARGRGHCSSISCLHSWFDSWGQGTLVTVSS

SEQ ID NO: 438 - protein, 19 aa, Artificial Sequence
  source: /note="Description of Artificial Sequence: Synthetic peptide"
ARGRGHCSSISCLHSWFDS

SEQ ID NO: 439 - protein, 109 aa, Artificial Sequence; identical to SEQ ID NO: 435
  source: /note="Description of Artificial Sequence: Synthetic polypeptide"

SEQ ID NO: 440 - protein, 10 aa, Artificial Sequence
  source: /note="Description of Artificial Sequence: Synthetic peptide"
QSYDTSLRVV

SEQ ID NO: 441 - protein, 125 aa, Artificial Sequence
  source: /note="Description of Artificial Sequence: Synthetic polypeptide"
EVQLVESGGGLVQPGGSLRLSCAASGFTFSNYDIHWVRQATGEGLEWVSAIGTAGDTYYPGSVKGRFTISRENAKNSVFLQMNSLRAGDTAVYYCARGRGHCSSISCLHSWFDSWGQGTLVTVSS

SEQ ID NO: 442 - protein, 19 aa, Artificial Sequence
  source: /note="Description of Artificial Sequence: Synthetic peptide"
ARGRGHCSSISCLHSWFDS

SEQ ID NO: 443 - protein, 109 aa, Artificial Sequence
  source: /note="Description of Artificial Sequence: Synthetic polypeptide"
QSVLTQPPSVSGAPGQRVTISCTGSSSNIGAGSDVHWYQKLPGTAPKVLIYGYNNRPSGVPDRFSGSKSGTSASLAITGLQAEDEADYYCQSYDTSLRVVFGGGTKLTV

SEQ ID NO: 444 - protein, 10 aa, Artificial Sequence
  source: /note="Description of Artificial Sequence: Synthetic peptide"
QSYDTSLRVV

SEQ ID NO: 445 - protein, 124 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKSGPYPWAVYYYGMDVWGQGTTVTVSS

SEQ ID NO: 446 - protein, 17 aa, Artificial Sequence
  source: /note="Description of Artificial Sequence: Synthetic peptide"
AKSGPYPWAVYYYGMDV

SEQ ID NO: 447 - protein, 109 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTVFGGGTKLTVL

SEQ ID NO: 448 - protein, 9 aa, Artificial Sequence
  source: /note="Description of Artificial Sequence: Synthetic peptide"
SSYTSSSTV

SEQ ID NO: 449 - protein, 124 aa, Artificial Sequence; identical to SEQ ID NO: 445
  source: /note="Description of Artificial Sequence: Synthetic polypeptide"

SEQ ID NO: 450 - protein, 17 aa, Artificial Sequence
  source: /note="Description of Artificial Sequence: Synthetic peptide"
AKSGPYPWAVYYYGMDV

SEQ ID NO: 451 - protein, 109 aa, Artificial Sequence; identical to SEQ ID NO: 447
  source: /note="Description of Artificial Sequence: Synthetic polypeptide"

SEQ ID NO: 452 - protein, 9 aa, Artificial Sequence
  source: /note="Description of Artificial Sequence: Synthetic peptide"
SSYTSSSTV

SEQ ID NO: 453 - protein, 124 aa, Artificial Sequence; identical to SEQ ID NO: 445
  source: /note="Description of Artificial Sequence: Synthetic polypeptide"

SEQ ID NO: 454 - protein, 17 aa, Artificial Sequence
  source: /note="Description of Artificial Sequence: Synthetic peptide"
AKSGPYPWAVYYYGMDV

SEQ ID NO: 455 - protein, 109 aa, Artificial Sequence; identical to SEQ ID NO: 447
  source: /note="Description of Artificial Sequence: Synthetic polypeptide"

SEQ ID NO: 456 - protein, 9 aa, Artificial Sequence
  source: /note="Description of Artificial Sequence: Synthetic peptide"
SSYTSSSTV

SEQ ID NO: 457 - protein, 122 aa, Artificial Sequence
  source: /note="Description of Artificial Sequence: Synthetic polypeptide"
QVQLVQSGAEVKKPGASVKVSCKASGYTFTGYYVHWVRQAPGQGLEWMGWINPNSGGTNYTQKFQGRVTMTRDRSISTAYMELSGLRSDDTAVYYCARDLTYGTVFYGMDVWGQGTTVTVSS

SEQ ID NO: 458 - protein, 15 aa, Artificial Sequence
  source: /note="Description of Artificial Sequence: Synthetic peptide"
ARDLTYGTVFYGMDV

SEQ ID NO: 459 - protein, 110 aa, Artificial Sequence
  source: /note="Description of Artificial Sequence: Synthetic polypeptide"
  MOD_RES (104)..(105): Any amino acid
QSVLTQPPSVSGAPGQRVTISCTGSSSNIGAGSDVHWYQKLPGTAPKVLIYGYSNRPSGVPDRFSGSKSGTSASLAITGLQAEDEADYYCQSYDTSLRVVFGGXXQAGPS

SEQ ID NO: 460 - protein, 10 aa, Artificial Sequence
  source: /note="Description of Artificial Sequence: Synthetic peptide"
QSYDTSLRVV

SEQ ID NO: 461 - protein, 119 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSSISSSGSTIYYADSVKGRFTISRDNAKTSLYLQMNSLRAEDTAVYYCARGKWLRGSFDYWGQGTLVTVSS

SEQ ID NO: 462 - protein, 12 aa, Artificial Sequence
  source: /note="Description of Artificial Sequence: Synthetic peptide"
ARGKWLRGSFDY

SEQ ID NO: 463 - protein, 104 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNGFGGGTKVEIK

SEQ ID NO: 464 - protein, 6 aa, Artificial Sequence
  source: /note="Description of Artificial Sequence: Synthetic peptide"
QQRSNG

SEQ ID NO: 465 - skipped

SEQ ID NO: 466 - protein, 17 aa, Artificial Sequence
  source: /note="Description of Artificial Sequence: Synthetic peptide"
ARGPSSTHESRPRPFDY

SEQ ID NO: 467 - protein, 110 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYSPGIFTFGQGTRLEIK

SEQ ID NO: 468 - protein, 12 aa, Artificial Sequence
  source: /note="Description of Artificial Sequence: Synthetic peptide"
QQYNSYSPGIFT

SEQ ID NO: 469 - protein, 128 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSVISGSGGSTYYADSVKGRFTISRDNFKNTLYLQMNSLRAEDTAVYYCAKDLEYYDSSGYPRPSEYFQHWGQGTLVTVSS

SEQ ID NO: 470 - protein, 13 aa, Artificial Sequence
  source: /note="Description of Artificial Sequence: Synthetic peptide"
TTSRGGDWPVTDY

SEQ ID NO: 471 - protein, 110 aa, Artificial Sequence
  source: /note="Description of Artificial Sequence: Synthetic polypeptide"
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNVWVFGGGTKLTVL

SEQ ID NO: 472 - protein, 11 aa, Artificial Sequence
  source: /note="Description of Artificial Sequence: Synthetic peptide"
AAWDDSLNVWV

SEQ ID NO: 473 - protein, 122 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVILYDGSNKYYADSVKGRFTISRDNAKNTLYLQMNSLRAEDTAVYYCAKPTHPGPSSEYFQHWGQGTLVTVSS

SEQ ID NO: 474 - protein, 21 aa, Artificial Sequence
  source: /note="Description of Artificial Sequence: Synthetic peptide"
AKDLEYYDSSGYPRPSEYFQH

SEQ ID NO: 475 - protein, 111 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 476 - protein, 11 aa, Artificial Sequence
  source: /note="Description of Artificial Sequence: Synthetic peptide"
QSYDSSLSGYV

SEQ ID NO: 477 - protein, 122 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKPTHPGPSSEYFQHWGQGTLVTVSS

SEQ ID NO: 478 - protein, 23 aa, Artificial Sequence
  source: /note="Description of Artificial Sequence: Synthetic peptide"
AKGGPDYYDSSGYIRSKPEYFQH

SEQ ID NO: 479 - protein, 110 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL

SEQ ID NO: 480 - protein, 10 aa, Artificial Sequence
  source: /note="Description of Artificial Sequence: Synthetic peptide"
QSYDSSLSVV

SEQ ID NO: 481 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKKGGLYGDYLNWFDPWGQGTLVTVSS

SEQ ID NO: 482 - protein, 15 aa, Artificial Sequence
  source: /note="Description of Artificial Sequence: Synthetic peptide"
AKPTHPGPSSEYFQH

SEQ ID NO: 483 - protein, 107 aa, Artificial Sequence [sequence omitted]

SEQ ID NO: 484 - protein, 9 aa, Artificial Sequence
  source: /note="Description of Artificial Sequence: Synthetic peptide"
QQFNSYPLT

SEQ ID NO: 485 - protein, 131 aa, Artificial Sequence
  source: /note="Description of Artificial Sequence: Synthetic polypeptide"
  MOD_RES (25)..(25): Any amino acid
QLQLQESGSGLVKPSQTLSLTCAVXGGSISSGGYSWSWIRQPPGKGLEWIGYIYHSGSTYYNPSLKSRVTISVDRSKNQFSLKLSSVTAADTAVYYCARGPPIEGWLRLGLGGGDWYFDLWGRGTLVTVSS

SEQ ID NO: 486 - protein, 15 aa, Artificial Sequence
  source: /note="Description of Artificial Sequence: Synthetic peptide"
AKPTHPGPSSEYFQH

SEQ ID NO: 487 - protein, 107 aa, Artificial Sequence
  source: /note="Description of Artificial Sequence: Synthetic polypeptide"
AIQLTQSPSSLSAFVGDRVTITCRASQGISSALAWYQQKPGKAPKLLIYDASSLESGVPSRFSGSGSGTDFTLTISSLQPEDFATYYCQQFNYYPLTFGGGTKVEIK

SEQ ID NO: 488 - protein, 9 aa, Artificial Sequence
  source: /note="Description of Artificial Sequence: Synthetic peptide"
QQFNYYPLT

SEQ ID NO: 489 - protein, 120 aa, Artificial Sequence
  source: /note="Description of Artificial Sequence: Synthetic polypeptide"
EVQLVQSGAEVKKPGESLRISCKGSGYSFTSYWISWVRQMPGKGLEWMGRIDPSDYYTNYSPSFQGHVTISADKSISTAYLQWSSLKASDTAMYYCARHDEVDTAAGGYWGQGTLVTVSS

SEQ ID NO: 490 - protein, 16 aa, Artificial Sequence
  source: /note="Description of Artificial Sequence: Synthetic peptide"
AKKGGLYGDYLNWFDP

SEQ ID NO: 491 - protein, 107 aa, Artificial Sequence; identical to SEQ ID NO: 118
  source: /note="Description of Artificial Sequence: Synthetic polypeptide"

SEQ ID NO: 492 - protein, 9 aa, Artificial Sequence
  source: /note="Description of Artificial Sequence: Synthetic peptide"
QQYDNLPLT

SEQ ID NO: 493-494 - skipped (2 entries)

SEQ ID NO: 495 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 496 - protein, 10 aa, Artificial Sequence
  source: /note="Description of Artificial Sequence: Synthetic peptide"
SSYTSSSTVV

SEQ ID NO: 497-498 - skipped (2 entries)

SEQ ID NO: 499 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSSYVFGTGTKVTVL

SEQ ID NO: 500 - protein, 10 aa, Artificial Sequence
  source: /note="Description of Artificial Sequence: Synthetic peptide"
SSYTSSSSYV

SEQ ID NO: 501 - protein, 124 aa, Artificial Sequence
  source: /note="Description of Artificial Sequence: Synthetic polypeptide"
QVQLVESGGGVVQPGRSLRLSCAASGFTFSIYGMHWVRQAPGKGLEWVAVISYDGSNKYYADSVKGRFTISRDNSKNTLYLQMNSLRAEDTAVYYCAKEGRPSDIVVVVAFDYWGQGTLVTVSS

SEQ ID NO: 502 - protein, 17 aa, Artificial Sequence
  source: /note="Description of Artificial Sequence: Synthetic peptide"
AKEGRPSDIVVVVAFDY

SEQ ID NO: 503 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 504 - protein, 9 aa, Artificial Sequence
  source: /note="Description of Artificial Sequence: Synthetic peptide"
QQSYSTPRT

SEQ ID NO: 505 - protein, 124 aa, Artificial Sequence; identical to SEQ ID NO: 501
  source: /note="Description of Artificial Sequence: Synthetic polypeptide"

SEQ ID NO: 506 - protein, 17 aa, Artificial Sequence
  source: /note="Description of Artificial Sequence: Synthetic peptide"
AKEGRPSDIVVVVAFDY

SEQ ID NO: 507 - protein, 107 aa, Artificial Sequence; identical to SEQ ID NO: 503
  source: /note="Description of Artificial Sequence: Synthetic polypeptide"

SEQ ID NO: 508 - protein, 9 aa, Artificial Sequence
  source: /note="Description of Artificial Sequence: Synthetic peptide"
QQSYSTPRT

SEQ ID NO: 509 - protein, 124 aa, Artificial Sequence; identical to SEQ ID NO: 501
  source: /note="Description of Artificial Sequence: Synthetic polypeptide"

SEQ ID NO: 510 - protein, 17 aa, Artificial Sequence
  source: /note="Description of Artificial Sequence: Synthetic peptide"
AKEGRPSDIVVVVAFDY

SEQ ID NO: 511 - protein, 107 aa, Artificial Sequence; identical to SEQ ID NO: 503
  source: /note="Description of Artificial Sequence: Synthetic polypeptide"

SEQ ID NO: 512 - protein, 9 aa, Artificial Sequence
  source: /note="Description of Artificial Sequence: Synthetic peptide"
QQSYSTPRT

SEQ ID NO: 513 - protein, 124 aa, Artificial Sequence; identical to SEQ ID NO: 501
  source: /note="Description of Artificial Sequence: Synthetic polypeptide"

SEQ ID NO: 514 - protein, 17 aa, Artificial Sequence
  source: /note="Description of Artificial Sequence: Synthetic peptide"
AKEGRPSDIVVVVAFDY

SEQ ID NO: 515 - protein, 107 aa, Artificial Sequence; identical to SEQ ID NO: 503
  source: /note="Description of Artificial Sequence: Synthetic polypeptide"

SEQ ID NO: 516 - protein, 9 aa, Artificial Sequence
  source: /note="Description of Artificial Sequence: Synthetic peptide"
QQSYSTPRT

SEQ ID NO: 517 - protein, 124 aa, Artificial Sequence; identical to SEQ ID NO: 501
  source: /note="Description of Artificial Sequence: Synthetic polypeptide"

SEQ ID NO: 518 - protein, 17 aa, Artificial Sequence
  source: /note="Description of Artificial Sequence: Synthetic peptide"
AKEGRPSDIVVVVAFDY

SEQ ID NO: 519 - protein, 107 aa, Artificial Sequence; identical to SEQ ID NO: 503
  source: /note="Description of Artificial Sequence: Synthetic polypeptide"

SEQ ID NO: 520 - protein, 9 aa, Artificial Sequence
  source: /note="Description of Artificial Sequence: Synthetic peptide"
QQSYSTPRT

SEQ ID NO: 521 - protein, 124 aa, Artificial Sequence; identical to SEQ ID NO: 501
  source: /note="Description of Artificial Sequence: Synthetic polypeptide"

SEQ ID NO: 522 - protein, 17 aa, Artificial Sequence
  source: /note="Description of Artificial Sequence: Synthetic peptide"
AKEGRPSDIVVVVAFDY

SEQ ID NO: 523 - protein, 107 aa, Artificial Sequence; identical to SEQ ID NO: 503
  source: /note="Description of Artificial Sequence: Synthetic polypeptide"

SEQ ID NO: 524 - protein, 9 aa, Artificial Sequence
  source: /note="Description of Artificial Sequence: Synthetic peptide"
QQSYSTPRT

SEQ ID NO: 525 - protein, 124 aa, Artificial Sequence; identical to SEQ ID NO: 501
  source: /note="Description of Artificial Sequence: Synthetic polypeptide"

SEQ ID NO: 526 - protein, 17 aa, Artificial Sequence
  source: /note="Description of Artificial Sequence: Synthetic peptide"
AKEGRPSDIVVVVAFDY

SEQ ID NO: 527 - protein, 107 aa, Artificial Sequence
  source: /note="Description of Artificial Sequence: Synthetic polypeptide"
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 528 - protein, 9 aa, Artificial Sequence
  source: /note="Description of Artificial Sequence: Synthetic peptide"
QQSYSTPRT

SEQ ID NO: 529 - protein, 124 aa, Artificial Sequence; identical to SEQ ID NO: 501
  source: /note="Description of Artificial Sequence: Synthetic polypeptide"

SEQ ID NO: 530 - protein, 17 aa, Artificial Sequence
  source: /note="Description of Artificial Sequence: Synthetic peptide"
AKEGRPSDIVVVVAFDY

SEQ ID NO: 531 - protein, 107 aa, Artificial Sequence; identical to SEQ ID NO: 503
  source: /note="Description of Artificial Sequence: Synthetic polypeptide"

SEQ ID NO: 532 - protein, 9 aa, Artificial Sequence
  source: /note="Description of Artificial Sequence: Synthetic peptide"
QQSYSTPRT

SEQ ID NO: 533 - protein, 124 aa, Artificial Sequence; identical to SEQ ID NO: 501
  source: /note="Description of Artificial Sequence: Synthetic polypeptide"

SEQ ID NO: 534 - protein, 17 aa, Artificial Sequence
  source: /note="Description of Artificial Sequence: Synthetic peptide"
AKEGRPSDIVVVVAFDY

SEQ ID NO: 535 - protein, 107 aa, Artificial Sequence; identical to SEQ ID NO: 503
  source: /note="Description of Artificial Sequence: Synthetic polypeptide"

SEQ ID NO: 536 - protein, 9 aa, Artificial Sequence
  source: /note="Description of Artificial Sequence: Synthetic peptide"
QQSYSTPRT

SEQ ID NO: 537 - protein, 124 aa, Artificial Sequence; identical to SEQ ID NO: 501
  source: /note="Description of Artificial Sequence: Synthetic polypeptide"

SEQ ID NO: 538 - protein, 17 aa, Artificial Sequence
  source: /note="Description of Artificial Sequence: Synthetic peptide"
AKEGRPSDIVVVVAFDY

SEQ ID NO: 539 - protein, 107 aa, Artificial Sequence; identical to SEQ ID NO: 503
  source: /note="Description of Artificial Sequence: Synthetic polypeptide"

SEQ ID NO: 540 - protein, 9 aa, Artificial Sequence
  source: /note="Description of Artificial Sequence: Synthetic peptide"
QQSYSTPRT

SEQ ID NO: 541 - protein, 124 aa, Artificial Sequence; identical to SEQ ID NO: 501
  source: /note="Description of Artificial Sequence: Synthetic polypeptide"

SEQ ID NO: 542 - protein, 17 aa, Artificial Sequence
  source: /note="Description of Artificial Sequence: Synthetic peptide"
AKEGRPSDIVVVVAFDY

SEQ ID NO: 543 - protein, 107 aa, Artificial Sequence; identical to SEQ ID NO: 503
  source: /note="Description of Artificial Sequence: Synthetic polypeptide"

SEQ ID NO: 544 - protein, 9 aa, Artificial Sequence
  source: /note="Description of Artificial Sequence: Synthetic peptide"
QQSYSTPRT

SEQ ID NO: 545 - protein, 124 aa, Artificial Sequence; identical to SEQ ID NO: 501
  source: /note="Description of Artificial Sequence: Synthetic polypeptide"

SEQ ID NO: 546 - protein, 17 aa, Artificial Sequence
  source: /note="Description of Artificial Sequence: Synthetic peptide"
AKEGRPSDIVVVVAFDY

SEQ ID NO: 547 - protein, 107 aa, Artificial Sequence; identical to SEQ ID NO: 503
  source: /note="Description of Artificial Sequence: Synthetic polypeptide"

SEQ ID NO: 548 - protein, 9 aa, Artificial Sequence
  source: /note="Description of Artificial Sequence: Synthetic peptide"
QQSYSTPRT

SEQ ID NO: 549 - protein, 124 aa, Artificial Sequence; identical to SEQ ID NO: 501
  source: /note="Description of Artificial Sequence: Synthetic polypeptide"

SEQ ID NO: 550 - protein, 17 aa, Artificial Sequence
  source: /note="Description of Artificial Sequence: Synthetic peptide"
AKEGRPSDIVVVVAFDY

SEQ ID NO: 551 - protein, 107 aa, Artificial Sequence; identical to SEQ ID NO: 503
  source: /note="Description of Artificial Sequence: Synthetic polypeptide"

SEQ ID NO: 552 - protein, 9 aa, Artificial Sequence
  source: /note="Description of Artificial Sequence: Synthetic peptide"
QQSYSTPRT

SEQ ID NO: 553 - protein, 128 aa, Artificial Sequence; identical to SEQ ID NO: 5
  source: /note="Description of Artificial Sequence: Synthetic polypeptide"

SEQ ID NO: 554 - protein, 21 aa, Artificial Sequence
  source: /note="Description of Artificial Sequence: Synthetic peptide"
ASPASRGYSGYDHGYYYYMDV

SEQ ID NO: 555 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 556 - protein, 9 aa, Artificial Sequence
  source: /note="Description of Artificial Sequence: Synthetic peptide"
QQYDNLPIT

SEQ ID NO: 557 - protein, 128 aa, Artificial Sequence; identical to SEQ ID NO: 5
  source: /note="Description of Artificial Sequence: Synthetic polypeptide"

SEQ ID NO: 558 - protein, 21 aa, Artificial Sequence
  source: /note="Description of Artificial Sequence: Synthetic peptide"
ASPASRGYSGYDHGYYYYMDV

SEQ ID NO: 559 - protein, 107 aa, Artificial Sequence; identical to SEQ ID NO: 555
  source: /note="Description of Artificial Sequence: Synthetic polypeptide"

SEQ ID NO: 560 - protein, 9 aa, Artificial Sequence
  source: /note="Description of Artificial Sequence: Synthetic peptide"
QQYDNLPIT

SEQ ID NO: 561 - protein, 128 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWLNPISGGTNYAQKFQGRVTMTRDTSISTAYMELSRLRSDDTAVYYCASPASRGYSGYDHGYYYYMDVWGKGTTVTVSS

SEQ ID NO: 562 - protein, 21 aa, Artificial Sequence
  source: /note="Description of Artificial Sequence: Synthetic peptide"
ASPASRGYSGYDHGYYYYMDV

SEQ ID NO: 563 - protein, 107 aa, Artificial Sequence; identical to SEQ ID NO: 555
  source: /note="Description of Artificial Sequence: Synthetic polypeptide"

SEQ ID NO: 564 - protein, 9 aa, Artificial Sequence
  source: /note="Description of Artificial Sequence: Synthetic peptide"
QQYDNLPIT

SEQ ID NO: 565 - protein, 125 aa, Artificial Sequence; identical to SEQ ID NO: 9
  source: /note="Description of Artificial Sequence: Synthetic polypeptide"

SEQ ID NO: 566 - protein, 18 aa, Artificial Sequence
  source: /note="Description of Artificial Sequence: Synthetic peptide"
ARRGDGSSSIYYYNYMDV

SEQ ID NO: 567 - protein, 110 aa, Artificial Sequence
  source: /note="Description of Artificial Sequence: Synthetic polypeptide"
  MOD_RES (110)..(110): Any amino acid
QSVLTQPPSASGTPGQRVTVSCSGSSSNIGSNTVNWYQQLPGTAPKLLIYSNNQRPSGVPDRFSGSKSGTSASLAISGLQSEDEADYFCAAWDDSLNGPVFGGGTKLTVX

SEQ ID NO: 568 - protein, 11 aa, Artificial Sequence
  source: /note="Description of Artificial Sequence: Synthetic peptide"
AAWDDSLNGPV

SEQ ID NO: 569 - protein, 125 aa, Artificial Sequence
  source: /note="Description of Artificial Sequence: Synthetic polypeptide"
QVQLVESGGGLVKPGGSLRLSCAASGFTFSDYCMSWIRQAPGKGLEWLSYISNSGTTRYYADSVKGRFTISRDNGRNSLYLQMNSLSAEDTAVYYCARRGDGSSSIYYYNYMDVWGKGTTVTVSS

SEQ ID NO: 570 - protein, 18 aa, Artificial Sequence
  source: /note="Description of Artificial Sequence: Synthetic peptide"
ARRGDGSSSIYYYNYMDV

SEQ ID NO: 571 - protein, 110 aa, Artificial Sequence
  source: /note="Description of Artificial Sequence: Synthetic polypeptide"
QSVLTQPPSASGTPGQRVTVSCSGSSSNIGSNTVNWYQQLPGTAPKLLIHSNNQRPSGVPDRFSGSKSGTSASLAISGLQSEDEADYYCAAWDDSLNGPVFGGGTKLTVL

SEQ ID NO: 572 - protein, 11 aa, Artificial Sequence
  source: /note="Description of Artificial Sequence: Synthetic peptide"
AAWDDSLNGPV

SEQ ID NO: 573 - protein, 125 aa, Artificial Sequence; identical to SEQ ID NO: 569
  source: /note="Description of Artificial Sequence: Synthetic polypeptide"

SEQ ID NO: 574 - protein, 18 aa, Artificial Sequence
  source: /note="Description of Artificial Sequence: Synthetic peptide"
ARRGDGSSSIYYYNYMDV

SEQ ID NO: 575 - protein, 110 aa, Artificial Sequence
  source: /note="Description of Artificial Sequence: Synthetic polypeptide"
QSVLTQPPSASGTPGQRVTVSCSGSSSNIGSNTINWYQQLPGTAPKLLIYSNNQRPSGVPDRFSGSKSGTSASLAISGLQSEDEANYYCAAWDDSLNGPVFGGGTKLTVL

SEQ ID NO: 576 - protein, 11 aa, Artificial Sequence
  source: /note="Description of Artificial Sequence: Synthetic peptide"
AAWDDSLNGPV

SEQ ID NO: 577 - protein, 123 aa, Artificial Sequence
  source: /note="Description of Artificial Sequence: Synthetic polypeptide"
QVQLVESGGGVVQPGRSLRLSCAASGFTYSGYAMHWVRQAPGKGLEWVAVILDDGSNKYYADSVKGRFTISRDNSKNTLYLQMNSLRAEDTAVYYCARDGIVDTAMVTWFDYWGQGTLVTVSS

SEQ ID NO: 578 - protein, 16 aa, Artificial Sequence
  source: /note="Description of Artificial Sequence: Synthetic peptide"
ARDGIVDTAMVTWFDY

SEQ ID NO: 579 - protein, 108 aa, Artificial Sequence
  source: /note="Description of Artificial Sequence: Synthetic polypeptide"
DIQMTQSPSSLSASVGDRVTITCRASQSISSYLNWYHQKPGKAPKLLIYTASSLQSGVPSRFSGSGSGTDFTLTISSLQPEDFATYYCQQSYSTPPWTFGQGTKVEIK

SEQ ID NO: 580 - protein, 10 aa, Artificial Sequence
  source: /note="Description of Artificial Sequence: Synthetic peptide"
QQSYSTPPWT

SEQ ID NO: 581 - protein, 120 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQGMATTYFDYWGQGTLVTVSS

SEQ ID NO: 582 - protein, 13 aa, Artificial Sequence
  source: /note="Description of Artificial Sequence: Synthetic peptide"
ARDQGMATTYFDY

SEQ ID NO: 583 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYFCQQSYNTPPWTFGQGTKVEIK

SEQ ID NO: 584 - protein, 10 aa, Artificial Sequence
  source: /note="Description of Artificial Sequence: Synthetic peptide"
QQSYNTPPWT

SEQ ID NO: 585 - protein, 123 aa, Artificial Sequence
  source: /note="Description of Artificial Sequence: Synthetic polypeptide"
QVQLVESGGGVVQPGRSLRLSCAASGFTFSSYAMHWVRQAPAKGLEWVAVILYDGSGKYYADSVKGRFTISRDNSKNTLYLQMNSLRAEDTAVYYCARDGIVDTALVTWFDYWGQGTLVTVSS

SEQ ID NO: 586 - protein, 16 aa, Artificial Sequence
  source: /note="Description of Artificial Sequence: Synthetic peptide"
ARDGIVDTALVTWFDY

SEQ ID NO: 587 - protein, 108 aa, Artificial Sequence
  source: /note="Description of Artificial Sequence: Synthetic polypeptide"
DIQMTQSPSSLSASVGDRVTITCRASQSISTYLNWYQQKPGKAPKLLIYAASSLQSGVPSRFSGSGSGTDFTLTISSLQPEDFATYYCQQSYSTPPWTFGQGTKVEIK

SEQ ID NO: 588 - protein, 10 aa, Artificial Sequence
  source: /note="Description of Artificial Sequence: Synthetic peptide"
QQSYSTPPWT

SEQ ID NO: 589 - protein, 122 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDSPFSGLGASNDYWGQGTLVTVSS

SEQ ID NO: 590 - protein, 15 aa, Artificial Sequence
  source: /note="Description of Artificial Sequence: Synthetic peptide"
ARDSPFSGLGASNDY

SEQ ID NO: 591 - protein, 110 aa, Artificial Sequence
  source: /note="Description of Artificial Sequence: Synthetic polypeptide"
QSVLTQPPSASGSPGQSVTISCTGTSSDVGGYNYVSWYQQHPGKAPKLMIYEVSKRPSGVPDRFSGSKSGNTASLTVSGLQAEDEADYYCSSDAGSNNVVFGGGTKLTVL

SEQ ID NO: 592 - protein, 10 aa, Artificial Sequence
  source: /note="Description of Artificial Sequence: Synthetic peptide"
SSDAGSNNVV

SEQ ID NO: 593 - protein, 122 aa, Artificial Sequence; identical to SEQ ID NO: 13
  source: /note="Description of Artificial Sequence: Synthetic polypeptide"

SEQ ID NO: 594 - protein, 15 aa, Artificial Sequence
  source: /note="Description of Artificial Sequence: Synthetic peptide"
ARDSPFSALGASNDY

SEQ ID NO: 595 - protein, 110 aa, Artificial Sequence; identical to SEQ ID NO: 14
  source: /note="Description of Artificial Sequence: Synthetic polypeptide"

SEQ ID NO: 596 - protein, 10 aa, Artificial Sequence
  source: /note="Description of Artificial Sequence: Synthetic peptide"
SSDAGSNNVV

SEQ ID NO: 597 - protein, 123 aa, Artificial Sequence
  source: /note="Description of Artificial Sequence: Synthetic polypeptide"
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCLDAFDIWGQGTMVTVSS

SEQ ID NO: 598 - protein, 16 aa, Artificial Sequence
  source: /note="Description of Artificial Sequence: Synthetic peptide"
AAPHCSGGSCLDAFDI

SEQ ID NO: 599 - protein, 108 aa, Artificial Sequence; identical to SEQ ID NO: 8
  source: /note="Description of Artificial Sequence: Synthetic polypeptide"

SEQ ID NO: 600 - protein, 9 aa, Artificial Sequence
  source: /note="Description of Artificial Sequence: Synthetic peptide"
QQYGSSPWT

SEQ ID NO: 601 - protein, 123 aa, Artificial Sequence
  source: /note="Description of Artificial Sequence: Synthetic polypeptide"
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPHCSGGSCYDAFDIWGQGTMVTVSS

SEQ ID NO: 602 - protein, 16 aa, Artificial Sequence
  source: /note="Description of Artificial Sequence: Synthetic peptide"
AAPHCSGGSCYDAFDI

SEQ ID NO: 603 - protein, 108 aa, Artificial Sequence
  source: /note="Description of Artificial Sequence: Synthetic polypeptide"
  MOD_RES (9)..(9): Any amino acid
EIVLTQSPXSLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 604 - protein, 9 aa, Artificial Sequence
  source: /note="Description of Artificial Sequence: Synthetic peptide"
QQYGSSPWT

SEQ ID NO: 605 - protein, 126 aa, Artificial Sequence
  source: /note="Description of Artificial Sequence: Synthetic polypeptide"
EVQLVESGGDLVKPGGSLRLSCAASGFTFNNAWMSWVRQAPGKGLEWVGRIKDKSDGETTDYAAPVQGRFTVSRDDSKNTLYLQMNSLKTEDTAVYYCTTGPHYDSSGYSYTVDSWGQGTLVTVSS

SEQ ID NO: 606 - protein, 17 aa, Artificial Sequence
  source: /note="Description of Artificial Sequence: Synthetic peptide"
TTGPHYDSSGYSYTVDS

SEQ ID NO: 607 - protein, 112 aa, Artificial Sequence
  source: /note="Description of Artificial Sequence: Synthetic polypeptide"
  MOD_RES (14)..(14): Any amino acid
DIVMTQSPLSLPVXPGEPASISCRSSQSLLHSNGFHFLEWYLQKPGQSPQLLIYSGSNRASGVPDRFSGSGSGTHFTLKISRVEAEDVGVYYCMQGLQTPLTFGGGTKVEIK

SEQ ID NO: 608 - protein, 9 aa, Artificial Sequence
  source: /note="Description of Artificial Sequence: Synthetic peptide"
MQGLQTPLT

SEQ ID NO: 609 - protein, 126 aa, Artificial Sequence
  source: /note="Description of Artificial Sequence: Synthetic polypeptide"
EVQLVESGGGLVKPGGSLRLSCAASGFTFSNAWMNWVRQAPGKGLEWVGRIKDKSDGGTIDYAAPVQGRFTISRDDSKNTLYLQMNSLKTEDTAVYYCTTGPHYDDSGYSYTVDYWGQGTLVTVSS

SEQ ID NO: 610 - protein, 17 aa, Artificial Sequence
  source: /note="Description of Artificial Sequence: Synthetic peptide"
TTGPHYDDSGYSYTVDY

SEQ ID NO: 611 - protein, 112 aa, Artificial Sequence
  source: /note="Description of Artificial Sequence: Synthetic polypeptide"
DIVMTQSPLSLPVTPGEPASISCRSSQSLLHSNGFHFLDWYLQKPGQTPQLLIYVGSNRASGVPDRFSGSGSGTDFTLKISRVEAEDVGVYYCMQALQTPLTFGGGTKVEIK

SEQ ID NO: 612 - protein, 9 aa, Artificial Sequence
  source: /note="Description of Artificial Sequence: Synthetic peptide"
MQALQTPLT

SEQ ID NO: 613 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGDCYSYYFDYWGQGTLVTVSS

SEQ ID NO: 614 - protein, 20 aa, Artificial Sequence
  source: /note="Description of Artificial Sequence: Synthetic peptide"
AKASGIYCSGGDCYSYYFDY

SEQ ID NO: 615 - protein, 106 aa, Artificial Sequence; identical to SEQ ID NO: 32
  source: /note="Description of Artificial Sequence: Synthetic polypeptide"

SEQ ID NO: 616 - protein, 8 aa, Artificial Sequence
  source: /note="Description of Artificial Sequence: Synthetic peptide"
QQYNSYST

SEQ ID NO: 617 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGIYCSGGNCYSYYFDYWGQGTLVTVSS

SEQ ID NO: 618 - protein, 20 aa, Artificial Sequence
  source: /note="Description of Artificial Sequence: Synthetic peptide"
AKASGIYCSGGNCYSYYFDY

SEQ ID NO: 619 - protein, 106 aa, Artificial Sequence; identical to SEQ ID NO: 32
  source: /note="Description of Artificial Sequence: Synthetic polypeptide"

SEQ ID NO: 620 - protein, 8 aa, Artificial Sequence
  source: /note="Description of Artificial Sequence: Synthetic peptide"
QQYNSYST

SEQ ID NO: 621 - protein, 126 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGTSWNSGTIGYADSVKGRFTISRDNAKNSLYLQMNSLRAEDTALYYCAKGRVVYAIDPDSVSPFDYWGQGTLVTVSS

SEQ ID NO: 622 - protein, 19 aa, Artificial Sequence
  source: /note="Description of Artificial Sequence: Synthetic peptide"
AKGRVVYAIDPDSVSPFDY

SEQ ID NO: 623 - protein, 111 aa, Artificial Sequence
  source: /note="Description of Artificial Sequence: Synthetic polypeptide"
QSVLTQPASVSGSPGQSITISCTGTSSGVGGYNFVSWYQQHPGKAPKLMIYDVSNRPSGVSNRFSGSKSGNTASLTISGLQAEDEADYHCSSYTSRSTLGVFGGGTKLTVL

SEQ ID NO: 624 - protein, 11 aa, Artificial Sequence
  source: /note="Description of Artificial Sequence: Synthetic peptide"
SSYTSRSTLGV

SEQ ID NO: 625 - protein, 124 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKPRKRGDYYGSGSYDYWGQGTLVTVSS

SEQ ID NO: 626 - protein, 17 aa, Artificial Sequence
  source: /note="Description of Artificial Sequence: Synthetic peptide"
AKPRKRGDYYGSGSYDY

SEQ ID NO: 627 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 628 - protein, 10 aa, Artificial Sequence
  source: /note="Description of Artificial Sequence: Synthetic peptide"
SSYTSSSTVV

SEQ ID NO: 629 - protein, 129 aa, Artificial Sequence
  source: /note="Description of Artificial Sequence: Synthetic polypeptide"
QLQLQESGPGLVKPSETLSVTCTVSGGSISSSRYYWGWIRQPPGKGLEWIGSIYYSGSTYYNPSLKSRVTISVDTSKNQFSLKLSSVTAADTAVYYCARHAAAYYDRSGYYFIEYFQHWGQGTLVTVSS

SEQ ID NO: 630 - protein, 21 aa, Artificial Sequence
  source: /note="Description of Artificial Sequence: Synthetic peptide"
ARHAAAYYDRSGYYFIEYFQH

SEQ ID NO: 631 - protein, 107 aa, Artificial Sequence; identical to SEQ ID NO: 30
  source: /note="Description of Artificial Sequence: Synthetic polypeptide"

SEQ ID NO: 632 - protein, 9 aa, Artificial Sequence
  source: /note="Description of Artificial Sequence: Synthetic peptide"
QQYNNYRYT

SEQ ID NO: 633 - protein, 129 aa, Artificial Sequence
  source: /note="Description of Artificial Sequence: Synthetic polypeptide"
  MOD_RES (121)..(121): Any amino acid
QLQLQESGPGLVKPSETLSLTCTVSGGSISSSNYYWGWIRQPPGKGLEWIGSIYYSGSTYYNPSLKSRVTISVDTSKNQFSLKVSSVTAADTAVYYCARHAAAYYDRSGYYFIEYFQHWGXGTLVTVSS

SEQ ID NO: 634 - protein, 21 aa, Artificial Sequence
  source: /note="Description of Artificial Sequence: Synthetic peptide"
ARHAAAYYDRSGYYFIEYFQH

SEQ ID NO: 635 - protein, 107 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQKYNSYRYTFGQGTKLEIK

SEQ ID NO: 636 - protein, 9 aa, Artificial Sequence
  source: /note="Description of Artificial Sequence: Synthetic peptide"
QKYNSYRYT

SEQ ID NO: 637 - protein, 120 aa, Artificial Sequence
  source: /note="Description of Artificial Sequence: Synthetic polypeptide"
QVQLVQSGAEVKKPGASVKVSCKASGYTFTNYGISWVRQAPGQGLEWMGWNSAYNGNTNYAQKLQGRVTMTTDTSTSTAYMELRSLRSDDTAVYYCARTDGTPAEYFQYWGQGTLVTVSS

SEQ ID NO: 638 - protein, 13 aa, Artificial Sequence
  source: /note="Description of Artificial Sequence: Synthetic peptide"
ARTDGTPAEYFQY

SEQ ID NO: 639 - protein, 111 aa, Artificial Sequence
  source: /note="Description of Artificial Sequence: Synthetic polypeptide"
QSVLTQPASVSGSPGQSITISCTGTSSDIGVYNYISWSQQHPGKAPKVMIYDVTNRPSGVSNRFSGSKSGNTASLTISGLQAEDEADYYCSSYRGSSTPYVFGTGTKVTVL

SEQ ID NO: 640 - protein, 11 aa, Artificial Sequence
  source: /note="Description of Artificial Sequence: Synthetic peptide"
SSYRGSSTPYV

SEQ ID NO: 641 - protein, 121 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLTSDDTAVYYCARGGQDELTGAFDIWGQGTMVTVSS

SEQ ID NO: 642 - protein, 14 aa, Artificial Sequence
  source: /note="Description of Artificial Sequence: Synthetic peptide"
ARGGQDELTGAFDI

SEQ ID NO: 643 - protein, 105 aa, Artificial Sequence
  source: /note="Description of Artificial Sequence: Synthetic polypeptide"
SYVLTQPPSVSVAPGKTARITCGGNSIGSKSVHWYQQKPGQAPVLVIYYDSDRPSGIPERFSGSNSGNTATLTISRVEAGDEADFHCQVWDSGWVFGGGTKLTVL

SEQ ID NO: 644 - protein, 8 aa, Artificial Sequence
  source: /note="Description of Artificial Sequence: Synthetic peptide"
QVWDSGWV

SEQ ID NO: 645 - protein, 125 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPISGGTNSAQKFQGRVTMTRDTSITTAYMELSSLRSDDTAVYHCAKSPYYYDSSGYLGGFDYWGQGTLVTVSS

SEQ ID NO: 646 - protein, 18 aa, Artificial Sequence
  source: /note="Description of Artificial Sequence: Synthetic peptide"
AKSPYYYDSSGYLGGFDY

SEQ ID NO: 647 - protein, 110 aa, Artificial Sequence
  source: /note="Description of Artificial Sequence: Synthetic polypeptide"
QSVLTQPASESGSPGQSITISCTGTSSDVGTYNLVSWYQQHPGKAPKLMIYEGSKRPSGVSNRFSGSKSGNTASLTISGLQAEDEADYYCCSYAASSTYVFGTGTKVTVL

SEQ ID NO: 648 - protein, 10 aa, Artificial Sequence
  source: /note="Description of Artificial Sequence: Synthetic peptide"
CSYAASSTYV

SEQ ID NO: 649 - protein, 122 aa, Artificial Sequence
  source: /note="Description of Artificial Sequence: Synthetic polypeptide"
  MOD_RES (114)..(114): Any amino acid
QVQLVQSGAEVKKPGASVKVSCKASGYTFTGYYMHWVRQAPGQGLEWMGWINPNSGGRNYTQKFQGRVTMTRDTSISTAYMELSRLRSDDTAVYYCARDLGYSYVQGYFDYWGXGTLVTVSS

SEQ ID NO: 650 - protein, 15 aa, Artificial Sequence
  source: /note="Description of Artificial Sequence: Synthetic peptide"
ARDLGYSYVQGYFDY

SEQ ID NO: 651 - protein, 110 aa, Artificial Sequence
  source: /note="Description of Artificial Sequence: Synthetic polypeptide"
QSALTQPASESGSPGQSITISCTGTSSDVGSYNLVSWYQQHPGKAPKLMIYEGSKRPSGVSNRFSGSKSGNTASLTISGLQAEDEADYYCCSYAGSNTWVFGGGTKLTVL

SEQ ID NO: 652 - protein, 10 aa, Artificial Sequence
  source: /note="Description of Artificial Sequence: Synthetic peptide"
CSYAGSNTWV

SEQ ID NO: 653 - protein, 122 aa, Artificial Sequence
  source: /note="Description of Artificial Sequence: Synthetic polypeptide"
QVQLVQSGAEVKKPGASVKVSCKASGYIFTGYYMHWVRQAPGQGLEWMGWINPNSGGTNYAQKFQGRVTMTRDTSISTVYMELSRLRSDDTAVYYCARDLGFSRLQFLFDYWGQGTLVTVSS

SEQ ID NO: 654 - protein, 15 aa, Artificial Sequence
  source: /note="Description of Artificial Sequence: Synthetic peptide"
ARDLGFSRLQFLFDY

SEQ ID NO: 655 - protein, 110 aa, Artificial Sequence
  source: /note="Description of Artificial Sequence: Synthetic polypeptide"
QSVLTQPASVSGSPGQSITISCTGTSSDVGSYNLVSWYQQHPGKAPKLMIYEVSKRPSGVSNRFSGSKSGNTASLTISGLQAEDEADYYCCSYAGSSIVVFGGGTKLTVL

SEQ ID NO: 656 - protein, 10 aa, Artificial Sequence
  source: /note="Description of Artificial Sequence: Synthetic peptide"
CSYAGSSIVV

SEQ ID NO: 657 - protein, 125 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCASTGYYILTGYEFGAMDVWGQGTTVTVSS

SEQ ID NO: 658 - protein, 18 aa, Artificial Sequence
  source: /note="Description of Artificial Sequence: Synthetic peptide"
ASTGYYILTGYEFGAMDV

SEQ ID NO: 659 - protein, 109 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVFGTGTKVTVL

SEQ ID NO: 660 - protein, 9 aa, Artificial Sequence
  source: /note="Description of Artificial Sequence: Synthetic peptide"
SSYTSSSTV

SEQ ID NO: 661 - protein, 123 aa, Artificial Sequence
  source: /note="Description of Artificial Sequence: Synthetic polypeptide"
QVQLVQSGAEVKKPGASVKVSCKASGYTFTDYYLHWVRQAPGQGLEWMGWINPTSGGTKYAQKFQGRVTMTRDTSITTAYMEVNRLRSDDTAVYYCARDRPLWFGVEYGMDVWGQGTTVTVSS

SEQ ID NO: 662 - protein, 16 aa, Artificial Sequence
  source: /note="Description of Artificial Sequence: Synthetic peptide"
ARDRPLWFGVEYGMDV

SEQ ID NO: 663 - protein, 110 aa, Artificial Sequence
  source: /note="Description of Artificial Sequence: Synthetic polypeptide"
QSVLTQPASVSGSPGQSITISCTGTNSDVGGYNYVSWYQQHPGKAPKLMIYDVGNRPSGVSNRFSGSKSGNTASLTISGLQAEDEADYYCSSYTSSSTLVFGGGTKLTVL

SEQ ID NO: 664 - protein, 10 aa, Artificial Sequence
  source: /note="Description of Artificial Sequence: Synthetic peptide"
SSYTSSSTLV

SEQ ID NO: 665 - protein, 129 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCATTEGQQLPHPPYYYYYYYMDVWGKGTTVTVSS

SEQ ID NO: 666 - protein, 22 aa, Artificial Sequence
  source: /note="Description of Artificial Sequence: Synthetic peptide"
ATTEGQQLPHPPYYYYYYYMDV

SEQ ID NO: 667 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL

SEQ ID NO: 668 - protein, 10 aa, Artificial Sequence
  source: /note="Description of Artificial Sequence: Synthetic peptide"
SSYTSSSTYV

SEQ ID NO: 669 - protein, 132 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARDRAETEGSETYYYDSSGYYLLGYWGQGTLVTVSS

SEQ ID NO: 670 - protein, 25 aa, Artificial Sequence
  source: /note="Description of Artificial Sequence: Synthetic peptide"
ARDRAETEGSETYYYDSSGYYLLGY

SEQ ID NO: 671 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPSFGQGTKVEIK

SEQ ID NO: 672 - protein, 9 aa, Artificial Sequence
  source: /note="Description of Artificial Sequence: Synthetic peptide"
QQSYSTPPS

SEQ ID NO: 673 - protein, 120 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARSSVTGTPPFDYWGQGTLVTVSS

SEQ ID NO: 674 - protein, 13 aa, Artificial Sequence
  source: /note="Description of Artificial Sequence: Synthetic peptide"
ARSSVTGTPPFDY

SEQ ID NO: 675 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTAILTISRVEAGDEADYYCQVWDSSSDHVVFGGGTKLTVL

SEQ ID NO: 676 - protein, 11 aa, Artificial Sequence
  source: /note="Description of Artificial Sequence: Synthetic peptide"
QVWDSSSDHVV

SEQ ID NO: 677 - protein, 120 aa, Artificial Sequence; identical to SEQ ID NO: 25
  source: /note="Description of Artificial Sequence: Synthetic polypeptide"

SEQ ID NO: 678 - protein, 13 aa, Artificial Sequence
  source: /note="Description of Artificial Sequence: Synthetic peptide"
ARVPREGTPGFDP

SEQ ID NO: 679 - protein, 108 aa, Artificial Sequence
  source: /note="Description of Artificial Sequence: Synthetic polypeptide"
SYVLTQPPSVSVAPGKTARITCGENNIGSKSVHWYQQKPGQAPVLVIYYDSDRPSGIPERFSGSNSGNTATLTINRVEAGDEADYYCQVWDSSSDHVVFGGGTKLTVL

SEQ ID NO: 680 - protein, 11 aa, Artificial Sequence
  source: /note="Description of Artificial Sequence: Synthetic peptide"
QVWDSSSDHVV

SEQ ID NO: 681 - protein, 123 aa, Artificial Sequence
  source: /note="Description of Artificial Sequence: Synthetic polypeptide"
  MOD_RES (25)..(25): Any amino acid
  MOD_RES (32)..(32): Any amino acid
  MOD_RES (53)..(53): Any amino acid
  MOD_RES (80)..(80): Any amino acid
  MOD_RES (88)..(88): Any amino acid
  MOD_RES (122)..(123): Any amino acid
QVQLVQSGAEVKKPGASVKVSCKAXGYTFTRXHMQWVGQAPGQGLEWMGIINXSGGSTSYAQKFQGRVTMARDTSTSSVXMELSSLRXRTRPCITVLVGISTIVVVRPAVWTSGAKGPRSPXX

SEQ ID NO: 682 - protein, 17 aa, Artificial Sequence
  source: /note="Description of Artificial Sequence: Synthetic peptide"
LVGISTIVVVRPAVWTS

SEQ ID NO: 683 - protein, 115 aa, Artificial Sequence
  source: /note="Description of Artificial Sequence: Synthetic polypeptide"
QSVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSRVFGGGTKLTVL

SEQ ID NO: 684 - protein, 9 aa, Artificial Sequence
  source: /note="Description of Artificial Sequence: Synthetic peptide"
GTWHSNSRV

SEQ ID NO: 685 - protein, 127 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVLYYYDSSGYPNLEYFQHWGQGTLVTVSS

SEQ ID NO: 686 - protein, 20 aa, Artificial Sequence
  source: /note="Description of Artificial Sequence: Synthetic peptide"
ARVLYYYDSSGYPNLEYFQH

SEQ ID NO: 687 - protein, 108 aa, Artificial Sequence
  source: /note="Description of Artificial Sequence: Synthetic polypeptide"
  MOD_RES (104)..(104): Any amino acid
DIQMTQSPSSLSASVGDRVTITCQASQDISNYLNWYQQKPGKAPKLLIYDASNLEAGVPSRFSGSGSGTDFTFTISSLQPEDIATYYCQQYDNLPSFTFGPGTXVDIK

SEQ ID NO: 688 - protein, 10 aa, Artificial Sequence
  source: /note="Description of Artificial Sequence: Synthetic peptide"
QQYDNLPSFT

SEQ ID NO: 689 - protein, 138 aa, Artificial Sequence; identical to SEQ ID NO: 17
  source: /note="Description of Artificial Sequence: Synthetic polypeptide"

SEQ ID NO: 690 - protein, 31 aa, Artificial Sequence
  source: /note="Description of Artificial Sequence: Synthetic polypeptide"
ARGNRLLYCSSTSCYLDAVRQGYYYYYYMDV

SEQ ID NO: 691 - protein, 110 aa, Artificial Sequence
  source: /note="Description of Artificial Sequence: Synthetic polypeptide"
QSVLTQPPSASGTPGQRVTISCSGSSSNIGSNSVNWFQQLPGTAPKLLIYSNNQRPSGVPDRFSGSKSGASASLAISGLQSEDEADYYCASWDDSLNGPLFGGGTKLTVL

SEQ ID NO: 692 - protein, 11 aa, Artificial Sequence
  source: /note="Description of Artificial Sequence: Synthetic peptide"
ASWDDSLNGPL

SEQ ID NO: 693 - protein, 138 aa, Artificial Sequence; identical to SEQ ID NO: 17
  source: /note="Description of Artificial Sequence: Synthetic polypeptide"

SEQ ID NO: 694 - protein, 31 aa, Artificial Sequence; identical to SEQ ID NO: 690
  source: /note="Description of Artificial Sequence: Synthetic polypeptide"

SEQ ID NO: 695 - protein, 110 aa, Artificial Sequence; identical to SEQ ID NO: 691
  source: /note="Description of Artificial Sequence: Synthetic polypeptide"

SEQ ID NO: 696 - protein, 11 aa, Artificial Sequence
  source: /note="Description of Artificial Sequence: Synthetic peptide"
ASWDDSLNGPL

SEQ ID NO: 697 - protein, 128 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADKSTSTAYMELSSLRSEDTAVCYCARVGYYYDRSGFPRTEDYFDYWGQGTLVTVSS

SEQ ID NO: 698 - protein, 21 aa, Artificial Sequence
  source: /note="Description of Artificial Sequence: Synthetic peptide"
ARVGYYYDRSGFPRTEDYFDY

SEQ ID NO: 699 - protein, 111 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 700 - protein, 11 aa, Artificial Sequence
  source: /note="Description of Artificial Sequence: Synthetic peptide"
QSYDSSLSGVV

SEQ ID NO: 701 - protein, 128 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFYTANYAQKFQGRVTITADKSTSTAYMELSSLRSEDTAVYYCARDEGYCSGGSCYGYYYGMDVWGQGTTVTVSS

SEQ ID NO: 702 - protein, 21 aa, Artificial Sequence
  source: /note="Description of Artificial Sequence: Synthetic peptide"
ARDEGYCSGGSCYGYYYGMDV

SEQ ID NO: 703 - protein, 108 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPMYTFGQGTKLEIK

SEQ ID NO: 704 - protein, 10 aa, Artificial Sequence
  source: /note="Description of Artificial Sequence: Synthetic peptide"
QQYDNLPMYT

SEQ ID NO: 705 - protein, 138 aa, Artificial Sequence; identical to SEQ ID NO: 17
  source: /note="Description of Artificial Sequence: Synthetic polypeptide"

SEQ ID NO: 706 - protein, 31 aa, Artificial Sequence; identical to SEQ ID NO: 690
  source: /note="Description of Artificial Sequence: Synthetic polypeptide"

SEQ ID NO: 707 - protein, 107 aa, Artificial Sequence; identical to SEQ ID NO: 18
  source: /note="Description of Artificial Sequence: Synthetic polypeptide"

SEQ ID NO: 708 - protein, 9 aa, Artificial Sequence
  source: /note="Description of Artificial Sequence: Synthetic peptide"
QQRSNWPLT

SEQ ID NO: 709 - protein, 120 aa, Artificial Sequence
  source: /note="Description of Artificial Sequence: Synthetic polypeptide"
QVQLVESGGGLVKPGGSLRLSCAASGFIFSDYYMSWIRQAPGKGLEWVSYISSSASTIYYADSVKGRFTISRDNAKNSLYLQMNSLRAEDTAVYYCARGLVYTPYRFGYWGQGTLVTVSS

SEQ ID NO: 710 - protein, 13 aa, Artificial Sequence
  source: /note="Description of Artificial Sequence: Synthetic peptide"
ARGLVYTPYRFGY

SEQ ID NO: 711 - protein, 106 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQHDNVVTFGPGTKVEIK

SEQ ID NO: 712 - protein, 8 aa, Artificial Sequence
  source: /note="Description of Artificial Sequence: Synthetic peptide"
QQHDNVVT

SEQ ID NO: 713 - protein, 118 aa, Artificial Sequence
  source: /note="Description of Artificial Sequence: Synthetic polypeptide"
QVQLVESGGGLVKPGGSLRLSCAASGFTFIDYYMSWIRQAPGKGLEWVSYISSSGSTIYYADSVKGRFTISRDNAKNSLYLQMNSLRAEDTAVYYCARGRTWELVDYWGQGTLVTVSS

SEQ ID NO: 714 - protein, 11 aa, Artificial Sequence
  source: /note="Description of Artificial Sequence: Synthetic peptide"
ARGRTWELVDY

SEQ ID NO: 715 - protein, 111 aa, Artificial Sequence; identical to SEQ ID NO: 639
  source: /note="Description of Artificial Sequence: Synthetic polypeptide"

SEQ ID NO: 716 - protein, 11 aa, Artificial Sequence
  source: /note="Description of Artificial Sequence: Synthetic peptide"
SSYRGSSTPYV

SEQ ID NO: 717 - protein, 118 aa, Artificial Sequence; identical to SEQ ID NO: 713
  source: /note="Description of Artificial Sequence: Synthetic polypeptide"

SEQ ID NO: 718 - protein, 12 aa, Artificial Sequence
  source: /note="Description of Artificial Sequence: Synthetic peptide"
ARGKWLRGSFDY

SEQ ID NO: 719 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVL

SEQ ID NO: 720 - protein, 10 aa, Artificial Sequence
  source: /note="Description of Artificial Sequence: Synthetic peptide"
QSYDSSNHWV

SEQ ID NO: 721 - protein, 123 aa, Artificial Sequence; identical to SEQ ID NO: 37
  source: /note="Description of Artificial Sequence: Synthetic polypeptide"

SEQ ID NO: 722 - protein, 17 aa, Artificial Sequence
  source: /note="Description of Artificial Sequence: Synthetic peptide"
ARVGYDSSGYSGWYFDL

SEQ ID NO: 723 - protein, 108 aa, Artificial Sequence; identical to SEQ ID NO: 38
  source: /note="Description of Artificial Sequence: Synthetic polypeptide"

SEQ ID NO: 724 - protein, 10 aa, Artificial Sequence
  source: /note="Description of Artificial Sequence: Synthetic peptide"
QQSYSTPPLT

SEQ ID NO: 725 - protein, 120 aa, Artificial Sequence
  source: /note="Description of Artificial Sequence: Synthetic polypeptide"
EVQLVESGGGLVQPGGSLRLSCAASGFTFSSYDMHWVRQATGKGLEWVSAIGTAGDTYYPDSVKGRFTISRENAKNSLYLQMNSLRAGDTAVYYCARGGGETITTVFDYWGQGTLVTVSS

SEQ ID NO: 726 - protein, 14 aa, Artificial Sequence
  source: /note="Description of Artificial Sequence: Synthetic peptide"
ARGGGETITTVFDY

SEQ ID NO: 727 - protein, 111 aa, Artificial Sequence; identical to SEQ ID NO: 639
  source: /note="Description of Artificial Sequence: Synthetic polypeptide"

SEQ ID NO: 728 - protein, 11 aa, Artificial Sequence
  source: /note="Description of Artificial Sequence: Synthetic peptide"
SSYRGSSTPYV

SEQ ID NO: 729 - protein, 120 aa, Artificial Sequence
  source: /note="Description of Artificial Sequence: Synthetic polypeptide"
EVQLVESGGGLVQPGGSLRLSCAASGFTFSSYDMHWVRQATGKGLEWVSIIGTAGDTYYPGSVKGRFTISRENAKNSLYLQMNSLRAGDTAVYYCARGSYSNYVGYMDVWGKGTTVTVSS

SEQ ID NO: 730 - protein, 14 aa, Artificial Sequence
  source: /note="Description of Artificial Sequence: Synthetic peptide"
ARGSYSNYVGYMDV

SEQ ID NO: 731 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPGLTFGGGTKVEIK

SEQ ID NO: 732 - protein, 10 aa, Artificial Sequence
  source: /note="Description of Artificial Sequence: Synthetic peptide"
QQSYSTPGLT

SEQ ID NO: 733 - protein, 127 aa, Artificial Sequence
  source: /note="Description of Artificial Sequence: Synthetic polypeptide"
EVQLVESGGGLVKPGGSLRLSCAASGFTFSDAWMSWVRQAPGKGLEWVGRLKSKTDGGTTDYAAPVKGRFTISRDDSKNTLSLQMNSLKTEDTAVYYCTTDQIYGDYLRMPVPFDYWGQGTLVTVSS

SEQ ID NO: 734 - protein, 18 aa, Artificial Sequence
  source: /note="Description of Artificial Sequence: Synthetic peptide"
TTDQIYGDYLRMPVPFDY

SEQ ID NO: 735 - protein, 110 aa, Artificial Sequence
  source: /note="Description of Artificial Sequence: Synthetic polypeptide"
QSVLTQPPSASGTPGQRVTISCSGSSSNIGSNYVYWYQQLPGTAPKLLIYRNNQRPSGVPDRFSGSKSGTSASLAISGLRSEDEADYYCATWDDSLSGPVFGGGTKLTVL

SEQ ID NO: 736 - protein, 11 aa, Artificial Sequence
  source: /note="Description of Artificial Sequence: Synthetic peptide"
ATWDDSLSGPV

SEQ ID NO: 737 - protein, 126 aa, Artificial Sequence
  source: /note="Description of Artificial Sequence: Synthetic polypeptide"
EVQLVESGGGLVKPGGSLRLSCAASGFTFSNAWMNWVRQAPGKGLEWIGRIKSNSDGGTTDYAAPVQGRFTILRDDSKNTLYLQMTSLRTEDTAVYFCTTGPQYDDNGYSYTVDYWGRGTLVTVSS

SEQ ID NO: 738 - protein, 17 aa, Artificial Sequence
  source: /note="Description of Artificial Sequence: Synthetic peptide"
TTGPQYDDNGYSYTVDY

SEQ ID NO: 739 - protein, 111 aa, Artificial Sequence; identical to SEQ ID NO: 130
  source: /note="Description of Artificial Sequence: Synthetic polypeptide"

SEQ ID NO: 740 - protein, 11 aa, Artificial Sequence
  source: /note="Description of Artificial Sequence: Synthetic peptide"
SSYRGSSTPYV

SEQ ID NO: 741 - protein, 124 aa, Artificial Sequence
  source: /note="Description of Artificial Sequence: Synthetic polypeptide"
  MOD_RES (118)..(118): Any amino acid
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREVKRVVAAPEYYFDYWGQGXLVTVSS

SEQ ID NO: 742 - protein, 17 aa, Artificial Sequence
  source: /note="Description of Artificial Sequence: Synthetic peptide"
AREVKRVVAAPEYYFDY

SEQ ID NO: 743 - protein, 110 aa, Artificial Sequence
  source: /note="Description of Artificial Sequence: Synthetic polypeptide"
QSVLTQPPSASGTPGQRVTISCSGISSNLGSNTVNWFQQLPGTAPKLLIYNSNRRPSGVPDRFSGSKSGTSASLAISGLQSEDEGDYYCAEWDDSLSTWVFGGGTHLTVL

SEQ ID NO: 744 - protein, 11 aa, Artificial Sequence
  source: /note="Description of Artificial Sequence: Synthetic peptide"
AEWDDSLSTWV

SEQ ID NO: 745 - protein, 124 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREVKRVVAAPEYYFDYWGQGTLVTVSS

SEQ ID NO: 746 - protein, 17 aa, Artificial Sequence
  source: /note="Description of Artificial Sequence: Synthetic peptide"
AREVKRVVAAPEYYFDY

SEQ ID NO: 747 - protein, 111 aa, Artificial Sequence; identical to SEQ ID NO: 639
  source: /note="Description of Artificial Sequence: Synthetic polypeptide"

SEQ ID NO: 748 - protein, 11 aa, Artificial Sequence
  source: /note="Description of Artificial Sequence: Synthetic peptide"
SSYRGSSTPYV

SEQ ID NO: 749 - protein, 128 aa, Artificial Sequence
  source: /note="Description of Artificial Sequence: Synthetic polypeptide"
EVQLVESGGGLVKPGGSLRLSCAASGFTFSTYNMNWVRQAPGKGLEWVSSITSSSSYIYYADSVKGRFTISRDNAENSLYLQMNSLRAEDTAVYYCARDRNRYDFWSGYYRLVGFDPWGQGTLVTVSS

SEQ ID NO: 750 - protein, 21 aa, Artificial Sequence
  source: /note="Description of Artificial Sequence: Synthetic peptide"
ARDRNRYDFWSGYYRLVGFDP

SEQ ID NO: 751 - protein, 110 aa, Artificial Sequence
  source: /note="Description of Artificial Sequence: Synthetic polypeptide"
QSVLTQPPSASGSPGQSVTISCTGTSSDVGGYKYVSWYQQHPGKAPKLMIYEVSKRPSGVPDRFSGSKSGNTASLTVSGLQAEDEADYYCSSYAGSNNHVFGGGTKLTVL

SEQ ID NO: 752 - protein, 10 aa, Artificial Sequence
  source: /note="Description of Artificial Sequence: Synthetic peptide"
SSYAGSNNHV

SEQ ID NO: 753 - protein, 120 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSGISDSGVSTYNADSVKGRFTISRDNSKNTLYLQMNSLRAEDTAVYYCAKVWSISLDAFDIWGQGTMVTVSS

SEQ ID NO: 754 - protein, 13 aa, Artificial Sequence
  source: /note="Description of Artificial Sequence: Synthetic peptide"
AKVWSISLDAFDI

SEQ ID NO: 755 - protein, 106 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDLFGGGTKLTVL

SEQ ID NO: 756 - protein, 9 aa, Artificial Sequence
  source: /note="Description of Artificial Sequence: Synthetic peptide"
QVWDSSSDL

SEQ ID NO: 757 - protein, 122 aa, Artificial Sequence
  source: /note="Description of Artificial Sequence: Synthetic polypeptide"
EVQLLESGGGLVQPGGSLRLSCAASGFTFNSYAMSWVRQAPGKGLEWVSGISGSGDSTYYADSVKGRFTISRDNSKNTVYLQMNSLRAEDTAVYYCAKDGGRQWLVELLDYWGHGTLVTVSS

SEQ ID NO: 758 - protein, 15 aa, Artificial Sequence
  source: /note="Description of Artificial Sequence: Synthetic peptide"
AKDGGRQWLVELLDY

SEQ ID NO: 759 - protein, 107 aa, Artificial Sequence
  source: /note="Description of Artificial Sequence: Synthetic polypeptide"
DIQMTQSPSSLSASVGDRVTITCRASQSIASYLNWFQQKPGKAPKLLIYAASSLQSGVPSRFSGSGSGTDFTLTISSLQPEDFATYCCQQSYSSPPTFGQGTKLEIK

SEQ ID NO: 760 - protein, 9 aa, Artificial Sequence
  source: /note="Description of Artificial Sequence: Synthetic peptide"
QQSYSSPPT

SEQ ID NO: 761 - protein, 120 aa, Artificial Sequence
  source: /note="Description of Artificial Sequence: Synthetic polypeptide"
EVQLLESGGGLVQPGGSLRLSCAASRFTFSNYAMSWVRQAPGKGLEWVSTISGSGGSTYYADSVKGRFTISRDNSKNTLYLQMNSLRAEDTAVYYCAKDRAAAHWATDYWGQGTLVTVSS

SEQ ID NO: 762 - protein, 13 aa, Artificial Sequence
  source: /note="Description of Artificial Sequence: Synthetic peptide"
AKDRAAAHWATDY

SEQ ID NO: 763 - protein, 107 aa, Artificial Sequence
  source: /note="Description of Artificial Sequence: Synthetic polypeptide"
  MOD_RES (9)..(10): Any amino acid
DIQMTQSPXXLSASVGDRVTITCQASQDISNYLNWYQQKPGKAPKLLIYDASNLETGVPSRFSGSGSGTDFTFTISSLQPEDIATYYCQQYDNRLFTFGPGTKVDIK

SEQ ID NO: 764 - protein, 9 aa, Artificial Sequence
  source: /note="Description of Artificial Sequence: Synthetic peptide"
QQYDNRLFT

SEQ ID NO: 765 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDSSGYHYYFDYWGQGTLVTVSS

SEQ ID NO: 766 - protein, 14 aa, Artificial Sequence
  source: /note="Description of Artificial Sequence: Synthetic peptide"
AKDDSSGYHYYFDY

SEQ ID NO: 767 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYNTPPITFGPGTKVDIK

SEQ ID NO: 768 - protein, 10 aa, Artificial Sequence
  source: /note="Description of Artificial Sequence: Synthetic peptide"
QQSYNTPPIT

SEQ ID NO: 769 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKDSGTAMVEIFDYWGQGTLVTVSS

SEQ ID NO: 770 - protein, 14 aa, Artificial Sequence
  source: /note="Description of Artificial Sequence: Synthetic peptide"
AKDSGTAMVEIFDY

SEQ ID NO: 771 - protein, 107 aa, Artificial Sequence
  source: /note="Description of Artificial Sequence: Synthetic polypeptide"
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYFCQQSYSSTLTFGGGTKVEIK

SEQ ID NO: 772 - protein, 9 aa, Artificial Sequence
  source: /note="Description of Artificial Sequence: Synthetic peptide"
QQSYSSTLT

SEQ ID NO: 773 - protein, 123 aa, Artificial Sequence
  source: /note="Description of Artificial Sequence: Synthetic polypeptide"
EVQLLESGGDLVQPGGSLRLSCAASGFTFSSYAMSWVRQAPGKGLEWVSAISGSGGSTYYADSVKGRFTISRDNSKSTLYLQMNSLRAEDTAVYYCAKDLRSTTFYVYYFDYWGQGTLVTVSS

SEQ ID NO: 774 - protein, 16 aa, Artificial Sequence
  source: /note="Description of Artificial Sequence: Synthetic peptide"
AKDLRSTTFYVYYFDY

SEQ ID NO: 775 - protein, 111 aa, Artificial Sequence
  source: /note="Description of Artificial Sequence: Synthetic polypeptide"
QSALTQPASVSGSPGQSITISCTGTSSDVGGYNYVSWYRQHPGKAPKLMIYDVSNRPSGVSNRFSGSKSGNTASLTISGLQAEDEADYYCSSYTSSSTPDVFGSGTKVTVL

SEQ ID NO: 776 - protein, 11 aa, Artificial Sequence
  source: /note="Description of Artificial Sequence: Synthetic peptide"
SSYTSSSTPDV

SEQ ID NO: 777 - protein, 124 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKVPIHYCSNGVCYFDYWGQGTLVTVSS

SEQ ID NO: 778 - protein, 17 aa, Artificial Sequence
  source: /note="Description of Artificial Sequence: Synthetic peptide"
AKVPIHYCSNGVCYFDY

SEQ ID NO: 779 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNRWVFGGGTKLTVL

SEQ ID NO: 780 - protein, 10 aa, Artificial Sequence
  source: /note="Description of Artificial Sequence: Synthetic peptide"
QSYDSSNRWV

SEQ ID NO: 781 - protein, 127 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGDSTYFADSVKGRFTISRDNSKNTLYLHMNSLRAEDTAVYYCAKVVGSGTPPDYYYYYYMDVWGKGTTVTVSS

SEQ ID NO: 782 - protein, 20 aa, Artificial Sequence
  source: /note="Description of Artificial Sequence: Synthetic peptide"
AKVVGSGTPPDYYYYYYMDV

SEQ ID NO: 783 - protein, 111 aa, Artificial Sequence; identical to SEQ ID NO: 130
  source: /note="Description of Artificial Sequence: Synthetic polypeptide"

SEQ ID NO: 784 - protein, 11 aa, Artificial Sequence
  source: /note="Description of Artificial Sequence: Synthetic peptide"
SSYRGSSTPYV

SEQ ID NO: 785 - protein, 126 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVISYDGSNKYFADSVKGRFTISRDNSKNTLYLQMNSLRAEDTAVYYCARATCSGGSCLFGQNAFDIWGQGTMVTVSS

SEQ ID NO: 786 - protein, 19 aa, Artificial Sequence
  source: /note="Description of Artificial Sequence: Synthetic peptide"
ARATCSGGSCLFGQNAFDI

SEQ ID NO: 787 - protein, 113 aa, Artificial Sequence
  source: /note="Description of Artificial Sequence: Synthetic polypeptide"
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPYTFGQGTKLEIK

SEQ ID NO: 788 - protein, 10 aa, Artificial Sequence
  source: /note="Description of Artificial Sequence: Synthetic peptide"
MQGTHWPPYT

SEQ ID NO: 789 - protein, 121 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSSKFYADSVKGRFTISRDNSKNTLYLQMNSLRAEDTAVYYCARDYGSSWYQVPDYWGQGTLVTVSS

SEQ ID NO: 790 - protein, 14 aa, Artificial Sequence
  source: /note="Description of Artificial Sequence: Synthetic peptide"
ARDYGSSWYQVPDY

SEQ ID NO: 791 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSRSGTDFTLTISSLQPEDFATYYCQQSYSTPPLTFGGGTKVEIK

SEQ ID NO: 792 - protein, 10 aa, Artificial Sequence
  source: /note="Description of Artificial Sequence: Synthetic peptide"
QQSYSTPPLT

SEQ ID NO: 793 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVTVISYDGRNKYYADSVKGRFTISRDNSKNTLYLQMNSLRAEDTAVYYCAREFGDPEWYFDYWGQGTLVTVSS

SEQ ID NO: 794 - protein, 13 aa, Artificial Sequence
  source: /note="Description of Artificial Sequence: Synthetic peptide"
AREFGDPEWYFDY

SEQ ID NO: 795 - protein, 106 aa, Artificial Sequence; identical to SEQ ID NO: 12
  source: /note="Description of Artificial Sequence: Synthetic polypeptide"

SEQ ID NO: 796 - protein, 8 aa, Artificial Sequence
  source: /note="Description of Artificial Sequence: Synthetic peptide"
QQYNSYWT

SEQ ID NO: 797 - protein, 122 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKNQNSYGYLSYFDYWGQGTLVTVSS

SEQ ID NO: 798 - protein, 15 aa, Artificial Sequence
  source: /note="Description of Artificial Sequence: Synthetic peptide"
AKNQNSYGYLSYFDY

SEQ ID NO: 799 - protein, 107 aa, Artificial Sequence
  source: /note="Description of Artificial Sequence: Synthetic polypeptide"
DIQMTQSPSSLSASVGDRVTITCQASQDINNYLNWYQQKPGKAPKLLIYDASNLETGVPSRFSGSGSGTDFAFTISSLQPEDIATYYCQQYDNLPRTFGQGTKVEIK

SEQ ID NO: 800 - protein, 9 aa, Artificial Sequence
  source: /note="Description of Artificial Sequence: Synthetic peptide"
QQYDNLPRT

SEQ ID NO: 801 - protein, 127 aa, Artificial Sequence
  source: /note="Description of Artificial Sequence: Synthetic polypeptide"
QVQLVESGGGVVQPGRSLRLSCAASGFTFRRYGIHWVRQAPGKGLEWVAVISYDGSNKYYADSVKGRFTISRDNSKNTLYLQMNSLRAEDTAVYYCAKASGEYCGGGSCYRGVFDYWGQGTLVTVSS

SEQ ID NO: 802 - protein, 20 aa, Artificial Sequence
  source: /note="Description of Artificial Sequence: Synthetic peptide"
AKASGEYCGGGSCYRGVFDY

SEQ ID NO: 803 - protein, 106 aa, Artificial Sequence
  source: /note="Description of Artificial Sequence: Synthetic polypeptide"
DIQMTQSPSSLSASVGDRVTITCQASQDISNYLNWYQQKPGKAPELLIYDASNLETGVPSRFSGSGSGTDFTFTISSLQPEDIATYYCQQYDNLPLTFGGGTKVEI

SEQ ID NO: 804 - protein, 9 aa, Artificial Sequence
  source: /note="Description of Artificial Sequence: Synthetic peptide"
QQYDNLPLT

SEQ ID NO: 805 - protein, 127 aa, Artificial Sequence
  source: /note="Description of Artificial Sequence: Synthetic polypeptide"
QVQLVESGGGVVQPGRSLRLSCATSGFTFSSYGLHWVRQAPGKGLEWVALISYDGSDKYYADSVKGRFTISRDTSKNTLFLQMNSLRAEDTAVYYCAKVMGPYCSGGSCYSGYFDYWGQGTLVTVSS

SEQ ID NO: 806 - protein, 20 aa, Artificial Sequence
  source: /note="Description of Artificial Sequence: Synthetic peptide"
AKVMGPYCSGGSCYSGYFDY

SEQ ID NO: 807 - protein, 107 aa, Artificial Sequence; identical to SEQ ID NO: 18
  source: /note="Description of Artificial Sequence: Synthetic polypeptide"

SEQ ID NO: 808 - protein, 9 aa, Artificial Sequence
  source: /note="Description of Artificial Sequence: Synthetic peptide"
QQRSNWPLT

SEQ ID NO: 809 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGGPYCSGGSCYSSYFDYWGQGTLVTVSS

SEQ ID NO: 810 - protein, 20 aa, Artificial Sequence
  source: /note="Description of Artificial Sequence: Synthetic peptide"
AKAGGPYCSGGSCYSSYFDY

SEQ ID NO: 811 - protein, 109 aa, Artificial Sequence
  source: /note="Description of Artificial Sequence: Synthetic polypeptide"
  MOD_RES (9)..(10): Any amino acid
EIVLTQSPXXLSLSPGERATLSCRASQSVSSRNLAWYQQKPGQAPRLLIDGASSRATGIPDRFSGSGSGTDFTLTISRLEPEDFAVYYCQQYGSSPAITFGQGTRLEIK

SEQ ID NO: 812 - protein, 10 aa, Artificial Sequence
  source: /note="Description of Artificial Sequence: Synthetic peptide"
QQYGSSPAIT

SEQ ID NO: 813 - protein, 124 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCARDCGGDCYPTTDAFDIWGQGTMVTVSS

SEQ ID NO: 814 - protein, 17 aa, Artificial Sequence
  source: /note="Description of Artificial Sequence: Synthetic peptide"
ARDCGGDCYPTTDAFDI

SEQ ID NO: 815 - protein, 107 aa, Artificial Sequence
  source: /note="Description of Artificial Sequence: Synthetic polypeptide"
DIQMTQSPSSLSASVGDRVTITCRASQSISSYLNWYQQKPGIAPKLLIYAASSLQSGVPSRFSGIGSGTDFTLTISSLQPEDFATYYCQQSYSTPWTFGQGTKVEIK

SEQ ID NO: 816 - protein, 9 aa, Artificial Sequence
  source: /note="Description of Artificial Sequence: Synthetic peptide"
QQSYSTPWT

SEQ ID NO: 817 - protein, 122 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSSKYYADSVKGRFTISRDNSKNTLYLQMNSLRAEDTAVYYCARDHDYGEIVDAFDIWGQGTMVTVSS

SEQ ID NO: 818 - protein, 15 aa, Artificial Sequence
  source: /note="Description of Artificial Sequence: Synthetic peptide"
ARDHDYGEIVDAFDI

SEQ ID NO: 819 - protein, 107 aa, Artificial Sequence
  source: /note="Description of Artificial Sequence: Synthetic polypeptide"
DIQMTQSPSSLSASVGDRVTITCRASQSISSYLNWYQQRPGKAPKLLIYAASSLQSGFPSRFSGSGSGTDFTLTISSLQPEDFATYYCQQSYSTLMYTFGQGTKLEI

SEQ ID NO: 820 - protein, 10 aa, Artificial Sequence
  source: /note="Description of Artificial Sequence: Synthetic peptide"
QQSYSTLMYT

SEQ ID NO: 821 - protein, 123 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSEDCSSTSCYLDYWGQGTLVTVSS

SEQ ID NO: 822 - protein, 16 aa, Artificial Sequence
  source: /note="Description of Artificial Sequence: Synthetic peptide"
ARDSEDCSSTSCYLDY

SEQ ID NO: 823 - protein, 113 aa, Artificial Sequence
  source: /note="Description of Artificial Sequence: Synthetic polypeptide"
  MOD_RES (9)..(9): Any amino acid
DIVMTQSPXSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 824 - protein, 9 aa, Artificial Sequence
  source: /note="Description of Artificial Sequence: Synthetic peptide"
QQYYSTPFT

SEQ ID NO: 825 - protein, 120 aa, Artificial Sequence
  source: /note="Description of Artificial Sequence: Synthetic polypeptide"
QVQLVESGGGVVQPGRSLRLSCAASGFTFSSYVMNWVRQAPGKGLAWVAVISFDGSNKYYADSVKGRFTVSRDNSKNTLYLQMNSLRAEDTALYYCARGPGWQWPELDYWGQGTLVTVSS

SEQ ID NO: 826 - protein, 13 aa, Artificial Sequence
  source: /note="Description of Artificial Sequence: Synthetic peptide"
ARGPGWQWPELDY

SEQ ID NO: 827 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTGPKLLIYSNNERPSGVPDRFSGSKSGTSASLAISGLQPEDEADYYCAAWDDSLNGPVFGTGTKVTVL

SEQ ID NO: 828 - protein, 11 aa, Artificial Sequence
  source: /note="Description of Artificial Sequence: Synthetic peptide"
AAWDDSLNGPV

SEQ ID NO: 829 - protein, 121 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCATEDYYDSSGSFDYWGQGTLVTVSS

SEQ ID NO: 830 - protein, 14 aa, Artificial Sequence
  source: /note="Description of Artificial Sequence: Synthetic peptide"
ATEDYYDSSGSFDY

SEQ ID NO: 831 - protein, 109 aa, Artificial Sequence
  source: /note="Description of Artificial Sequence: Synthetic polypeptide"
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSFWVFGGGTKLTVL

SEQ ID NO: 832 - protein, 9 aa, Artificial Sequence
  source: /note="Description of Artificial Sequence: Synthetic peptide"
CSYAGSFWV

SEQ ID NO: 833 - protein, 113 aa, Artificial Sequence
  source: /note="Description of Artificial Sequence: Synthetic polypeptide"
QVQLVESGGGVVQPERSLRLSCAASGFTFSSYAMHWVRQAPGKGLEWVAVISYDGSNKYYADSVKGRFTISRDNSKNTLYLQMNSLRAEDTAVYYCARSKSYTSWGYYHMDVW

SEQ ID NO: 834 - protein, 16 aa, Artificial Sequence
  source: /note="Description of Artificial Sequence: Synthetic peptide"
ARSKSYTSWGYYHMDV

SEQ ID NO: 835 - protein, 110 aa, Artificial Sequence
  source: /note="Description of Artificial Sequence: Synthetic polypeptide"
QSVLTQPASVSGSPGQSITISCAGTSSDVGAYNYVSWYQQHPGKAPKLMIYDVSNRPSGVSNRFSGSKSGNTASLTISGLQAEDEADYYCSSYTSSSTWVFGGGTKLTVL

SEQ ID NO: 836 - protein, 10 aa, Artificial Sequence
  source: /note="Description of Artificial Sequence: Synthetic peptide"
SSYTSSSTWV

SEQ ID NO: 837 - protein, 125 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDGTSITLITEGDAFDIWGQGTMVTVSS

SEQ ID NO: 838 - protein, 18 aa, Artificial Sequence
  source: /note="Description of Artificial Sequence: Synthetic peptide"
ARDGTSITLITEGDAFDI

SEQ ID NO: 839 - protein, 107 aa, Artificial Sequence
  source: /note="Description of Artificial Sequence: Synthetic polypeptide"
DIQMTQSPSSVSASVGDRVTITCRASQGISSWLAWYQQKPGKAPKLLIYAASSLQSGVPSRFSGSGSGTDFTLTISSLQPEDFATYYCQQANSLPLTFGGGTKVEIK

SEQ ID NO: 840 - protein, 9 aa, Artificial Sequence
  source: /note="Description of Artificial Sequence: Synthetic peptide"
QQANSLPLT

SEQ ID NO: 841 - protein, 122 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWHDGSNKYYADSVKGRFTISRDNSKNTLYLQMNSLRAEDTALYYCARDPSVVVTAIDFDYWGQGTLVTVSS

SEQ ID NO: 842 - protein, 15 aa, Artificial Sequence
  source: /note="Description of Artificial Sequence: Synthetic peptide"
ARDPSVVVTAIDFDY

SEQ ID NO: 843 - protein, 112 aa, Artificial Sequence
  source: /note="Description of Artificial Sequence: Synthetic polypeptide"
DVVMTQSPLSLPVTLGQPASISCRSSQSLVFSDGNTYLNWFQQRPGQSPRRLIYKVSNRDSGVPDRFSGSGSGTDFTLKISRVEAEDVGVYFCMQGTHWPWTFGQGTKVEIK

SEQ ID NO: 844 - protein, 9 aa, Artificial Sequence
  source: /note="Description of Artificial Sequence: Synthetic peptide"
MQGTHWPWT

SEQ ID NO: 845 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREHTPTDIVVVNVEYWGQGTLVTVSS

SEQ ID NO: 846 - protein, 16 aa, Artificial Sequence
  source: /note="Description of Artificial Sequence: Synthetic peptide"
AREHTPTDIVVVNVEY

SEQ ID NO: 847 - protein, 112 aa, Artificial Sequence
  source: /note="Description of Artificial Sequence: Synthetic polypeptide"
DVVMTQSPLSLPVTLGQPASISCRSSQSLVYIDGNTYLNWFQQRPGQSPRRLIYKVSNRDSGVPDRFSGSGSGTDFTLKISRVEAEDVGVYYCMQGTHWPYTFGQGTKLEIK

SEQ ID NO: 848 - protein, 9 aa, Artificial Sequence
  source: /note="Description of Artificial Sequence: Synthetic peptide"
MQGTHWPYT

SEQ ID NO: 849 - protein, 120 aa, Artificial Sequence
  source: /note="Description of Artificial Sequence: Synthetic polypeptide"
QVQLVESGGGVVQPGRSLRLSCAASGFTFSSYCMHWVRQAPGKGLEWVAVIWYDGNNKYYADSVKGRFTISRDNSKNTLYLQMNSLRAEDTAVYYCAREKDIVATDFDYWGQGTLVTVSS

SEQ ID NO: 850 - protein, 13 aa, Artificial Sequence
  source: /note="Description of Artificial Sequence: Synthetic peptide"
AREKDIVATDFDY

SEQ ID NO: 851 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPYVFGTGTKVTVL

SEQ ID NO: 852 - protein, 12 aa, Artificial Sequence
  source: /note="Description of Artificial Sequence: Synthetic peptide"
QSYDSSLSGPYV

SEQ ID NO: 853 - protein, 126 aa, Artificial Sequence
  source: /note="Description of Artificial Sequence: Synthetic polypeptide"
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCAREYFYDSSDYYFEYYFDYWGQGTLVTVSS

SEQ ID NO: 854 - protein, 19 aa, Artificial Sequence
  source: /note="Description of Artificial Sequence: Synthetic peptide"
AREYFYDSSDYYFEYYFDY

SEQ ID NO: 855 - protein, 110 aa, Artificial Sequence
  source: /note="Description of Artificial Sequence: Synthetic polypeptide"
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTYVFGTGTKVTVL

SEQ ID NO: 856 - protein, 10 aa, Artificial Sequence
  source: /note="Description of Artificial Sequence: Synthetic peptide"
CSYAGSYTYV

SEQ ID NO: 857 - protein, 124 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDHSLGVRGDGYGMDVWGQGTTVTVSS

SEQ ID NO: 858 - protein, 17 aa, Artificial Sequence
  source: /note="Description of Artificial Sequence: Synthetic peptide"
ARDHSLGVRGDGYGMDV

SEQ ID NO: 859 - protein, 107 aa, Artificial Sequence
  source: /note="Description of Artificial Sequence: Synthetic polypeptide"
AIQLTQSPSSLSASVGDRVTITCRASQGISSALAWYQQKPGKAPKFLIYDASSLESGVPSRFSGSGSGTDFTLTISSLQPEDFATYYCQQFNNYPLTFGGGTKVEIK

SEQ ID NO: 860 - protein, 9 aa, Artificial Sequence
  source: /note="Description of Artificial Sequence: Synthetic peptide"
QQFNNYPLT

SEQ ID NO: 861 - protein, 131 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGAVVRFLEWPTVGYYYYYMDVWGKGTTVTVSS

SEQ ID NO: 862 - protein, 24 aa, Artificial Sequence
  source: /note="Description of Artificial Sequence: Synthetic peptide"
ARDGAVVRFLEWPTVGYYYYYMDV

SEQ ID NO: 863 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 864 - protein, 9 aa, Artificial Sequence
  source: /note="Description of Artificial Sequence: Synthetic peptide"
MQALQTPIT

SEQ ID NO: 865 - protein, 124 aa, Artificial Sequence
  source: /note="Description of Artificial Sequence: Synthetic polypeptide"
QVQLVESGGGVVQPGRSLRLSCAASGFTFTSYGMHWVRQAPGKGLEWVAVIWYDGSNKYYADSVKGRFTISRDNSKNTLYLQMNSLRAEDTAVYYCARDMMIRGVAWYYYMDVWGKGTTVTVSS

SEQ ID NO: 866 - protein, 17 aa, Artificial Sequence
  source: /note="Description of Artificial Sequence: Synthetic peptide"
ARDMMIRGVAWYYYMDV

SEQ ID NO: 867 - protein, 109 aa, Artificial Sequence
  source: /note="Description of Artificial Sequence: Synthetic polypeptide"
QSVLTQPASVSGSPGQSITISCTGTSSDVGGYNYVSWYQQHPGKAPKLIIYNVSNRPSGVSNRFSGSKSGNTASLTISGLQAEDEADYYCSSYISSNTVFGGGTKLTVL

SEQ ID NO: 868 - protein, 9 aa, Artificial Sequence
  source: /note="Description of Artificial Sequence: Synthetic peptide"
SSYISSNTV

SEQ ID NO: 869 - protein, 123 aa, Artificial Sequence
  source: /note="Description of Artificial Sequence: Synthetic polypeptide"
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDSGGDIVVIPAVNGFDYWGQGTLVT

SEQ ID NO: 870 - protein, 19 aa, Artificial Sequence
  source: /note="Description of Artificial Sequence: Synthetic peptide"
ARDSGGDIVVIPAVNGFDY

SEQ ID NO: 871 - protein, 105 aa, Artificial Sequence
  source: /note="Description of Artificial Sequence: Synthetic polypeptide"
SYVLTQPPSVSVSPGQTARITCSGDALPNQYAYWYQQKPGQAPVLVIYKDSERPSGIPERFSGSSSGTTVTLTISGVQAEDEADYYCQSADSRGVFGGGTKLTVL

SEQ ID NO: 872 - protein, 8 aa, Artificial Sequence
  source: /note="Description of Artificial Sequence: Synthetic peptide"
QSADSRGV

SEQ ID NO: 873 - protein, 128 aa, Artificial Sequence
  source: /note="Description of Artificial Sequence: Synthetic polypeptide"
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREAHDGALTDYGDYLNWFDPWGQGTLVTVSS

SEQ ID NO: 874 - protein, 21 aa, Artificial Sequence
  source: /note="Description of Artificial Sequence: Synthetic peptide"
AREAHDGALTDYGDYLNWFDP

SEQ ID NO: 875 - protein, 110 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHLYWVFGGGTKLTVL

SEQ ID NO: 876 - protein, 13 aa, Artificial Sequence
  source: /note="Description of Artificial Sequence: Synthetic peptide"
QVWDSSSDHLYWV

SEQ ID NO: 877 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLYSSGGTDIWGQGTMVTVSS

SEQ ID NO: 878 - protein, 12 aa, Artificial Sequence
  source: /note="Description of Artificial Sequence: Synthetic peptide"
ARDLYSSGGTDI

SEQ ID NO: 879 - protein, 108 aa, Artificial Sequence
  source: /note="Description of Artificial Sequence: Synthetic polypeptide"
EIVLTQSPVSLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK

SEQ ID NO: 880 - protein, 9 aa, Artificial Sequence
  source: /note="Description of Artificial Sequence: Synthetic peptide"
QQYGSSPGT

SEQ ID NO: 881 - protein, 118 aa, Artificial Sequence; identical to SEQ ID NO: 877
  source: /note="Description of Artificial Sequence: Synthetic polypeptide"

SEQ ID NO: 882 - protein, 12 aa, Artificial Sequence
  source: /note="Description of Artificial Sequence: Synthetic peptide"
ARDLYSSGGTDI

SEQ ID NO: 883 - protein, 111 aa, Artificial Sequence; identical to SEQ ID NO: 639
  source: /note="Description of Artificial Sequence: Synthetic polypeptide"

SEQ ID NO: 884 - protein, 11 aa, Artificial Sequence
  source: /note="Description of Artificial Sequence: Synthetic peptide"
SSYRGSSTPYV

SEQ ID NO: 885 - protein, 117 aa, Artificial Sequence
  source: /note="Description of Artificial Sequence: Synthetic polypeptide"
EVQLVESGGGLIQPGGSLRLSCAASGFTVSSNYMTWVRQAPGKGLEWVSLIYSGGSTFYADSVKGRFTISRDSSKNTLYLQMNSLRAEDTAVYYCARGYGDYYFDYWGQGTLVTVSS

SEQ ID NO: 886 - protein, 11 aa, Artificial Sequence
  source: /note="Description of Artificial Sequence: Synthetic peptide"
ARGYGDYYFDY

SEQ ID NO: 887 - protein, 103 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDSATYYCQHLNGFGPGTKVDIK

SEQ ID NO: 888 - protein, 5 aa, Artificial Sequence
  source: /note="Description of Artificial Sequence: Synthetic peptide"
QHLNG

SEQ ID NO: 889 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 890 - protein, 11 aa, Artificial Sequence
  source: /note="Description of Artificial Sequence: Synthetic peptide"
ARDYGDFYFDY

SEQ ID NO: 891 - protein, 107 aa, Artificial Sequence
  source: /note="Description of Artificial Sequence: Synthetic polypeptide"
DIQMTQSPSSLSASVGDRVTITCRASQGISNSLAWYQQKPGKAPKLLLYAASRLESGVPSRFSGSGSGTDYTLTINSLQPEDFATFYCQQYYSTPRTFGQGTKVEIK

SEQ ID NO: 892 - protein, 9 aa, Artificial Sequence
  source: /note="Description of Artificial Sequence: Synthetic peptide"
QQYYSTPRT

SEQ ID NO: 893 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGDYYFDYWGQGTLVTVSS

SEQ ID NO: 894 - protein, 11 aa, Artificial Sequence
  source: /note="Description of Artificial Sequence: Synthetic peptide"
ARDWGDYYFDY

SEQ ID NO: 895 - protein, 108 aa, Artificial Sequence; identical to SEQ ID NO: 52
  source: /note="Description of Artificial Sequence: Synthetic polypeptide"

SEQ ID NO: 896 - protein, 9 aa, Artificial Sequence
  source: /note="Description of Artificial Sequence: Synthetic peptide"
QQYGSSPRT

SEQ ID NO: 897 - protein, 117 aa, Artificial Sequence; identical to SEQ ID NO: 3
  source: /note="Description of Artificial Sequence: Synthetic polypeptide"

SEQ ID NO: 898 - protein, 11 aa, Artificial Sequence
  source: /note="Description of Artificial Sequence: Synthetic peptide"
ARDYGDFYFDY

SEQ ID NO: 899 - protein, 108 aa, Artificial Sequence; identical to SEQ ID NO: 4
  source: /note="Description of Artificial Sequence: Synthetic polypeptide"

SEQ ID NO: 900 - protein, 9 aa, Artificial Sequence
  source: /note="Description of Artificial Sequence: Synthetic peptide"
QQYGSSPRT

SEQ ID NO: 901 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLSVFGMDVWGQGTTVTVSS

SEQ ID NO: 902 - protein, 11 aa, Artificial Sequence
  source: /note="Description of Artificial Sequence: Synthetic peptide"
ARDLSVFGMDV

SEQ ID NO: 903 - protein, 105 aa, Artificial Sequence
  source: /note="Description of Artificial Sequence: Synthetic polypeptide"
  MOD_RES (86)..(86): Any amino acid
DIQLTQSPSFLSASVGDRVTVTCRASQGISSYLAWYQQKPGKAPKLLIYAASTLQSGVPSRFSGSGSGTEFTLTISSLQPEDFATXYCQQVNSYSHFGGGSKAEI

SEQ ID NO: 904 - protein, 8 aa, Artificial Sequence
  source: /note="Description of Artificial Sequence: Synthetic peptide"
QQVNSYSH

SEQ ID NO: 905 - protein, 117 aa, Artificial Sequence
  source: /note="Description of Artificial Sequence: Synthetic polypeptide"
EVQLVESGGGLIQPGGSLRVSCAASGFTVSSNYMSWVRQAPGKGLEWVSVIYSGGSTYYADSVKGRFTISRDNSKNTLSLQMNSLRAEDTAVYYCARDLGERGMDVWGQGTTVTVSS

SEQ ID NO: 906 - protein, 11 aa, Artificial Sequence
  source: /note="Description of Artificial Sequence: Synthetic peptide"
ARDLGERGMDV

SEQ ID NO: 907 - protein, 111 aa, Artificial Sequence; identical to SEQ ID NO: 639
  source: /note="Description of Artificial Sequence: Synthetic polypeptide"

SEQ ID NO: 908 - protein, 11 aa, Artificial Sequence
  source: /note="Description of Artificial Sequence: Synthetic peptide"
SSYRGSSTPYV

SEQ ID NO: 909 - protein, 129 aa, Artificial Sequence
  source: /note="Description of Artificial Sequence: Synthetic polypeptide"
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYCSGGSCHPPGQWLSDAFDIWGQGTMVTVSS

SEQ ID NO: 910 - protein, 22 aa, Artificial Sequence
  source: /note="Description of Artificial Sequence: Synthetic peptide"
ARYCSGGSCHPPGQWLSDAFDI

SEQ ID NO: 911 - protein, 106 aa, Artificial Sequence
  source: /note="Description of Artificial Sequence: Synthetic polypeptide"
  MOD_RES (9)..(9): Any amino acid
DIQMTQSPXSLSASVGDRVTITCRASQSISSYLNWYQQKPGKAPKLLIYAASSLQSGVPSRFSGSGSGTDFTLTISSLQPEDFATYYCQQSYSTWTFGQGTKVEIK

SEQ ID NO: 912 - protein, 8 aa, Artificial Sequence
  source: /note="Description of Artificial Sequence: Synthetic peptide"
QQSYSTWT

SEQ ID NO: 913 - protein, 119 aa, Artificial Sequence
  source: /note="Description of Artificial Sequence: Synthetic polypeptide"
EVQLVESGGGLVQPGGSLRLSCAASGFTFSSYWMSWVRQAPGKGLEWVTNIKLDGSEKYYVDSVKGRFTISRDNAKNSLYLQMNSLRAEDTAVYYCARLRWLRADFDYWGQGTLVTVSS

SEQ ID NO: 914 - protein, 12 aa, Artificial Sequence
  source: /note="Description of Artificial Sequence: Synthetic peptide"
ARLRWLRADFDY

SEQ ID NO: 915 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSGNVVFGGGTKLTVL

SEQ ID NO: 916 - protein, 9 aa, Artificial Sequence
  source: /note="Description of Artificial Sequence: Synthetic peptide"
QSYDSGNVV

SEQ ID NO: 917 - protein, 126 aa, Artificial Sequence
  source: /note="Description of Artificial Sequence: Synthetic polypeptide"
  MOD_RES (118)..(118): Any amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYYDILTGYYVDYYYMDVWGXGTTVTVSS

SEQ ID NO: 918 - protein, 19 aa, Artificial Sequence
  source: /note="Description of Artificial Sequence: Synthetic peptide"
ARYYDILTGYYVDYYYMDV

SEQ ID NO: 919 - protein, 108 aa, Artificial Sequence
  source: /note="Description of Artificial Sequence: Synthetic polypeptide"
SYVLTQPPSVSVSPGQTARITCSGDALPKQYAFWYQQKPGQAPVLVIYKDSERPSGIPERFSGSSSGTTVTLTISGVQAEDEADYYCQSADSSGTYVVFGGGTRLTVL

SEQ ID NO: 920 - protein, 11 aa, Artificial Sequence
  source: /note="Description of Artificial Sequence: Synthetic peptide"
QSADSSGTYVV

SEQ ID NO: 921 - protein, 120 aa, Artificial Sequence; identical to SEQ ID NO: 377
  source: /note="Description of Artificial Sequence: Synthetic polypeptide"

SEQ ID NO: 922 - protein, 13 aa, Artificial Sequence
  source: /note="Description of Artificial Sequence: Synthetic peptide"
TRDDSSWPHFFDN

SEQ ID NO: 923 - protein, 106 aa, Artificial Sequence
  source: /note="Description of Artificial Sequence: Synthetic polypeptide"
DIQMTQSPSSLSASVGDRVTITCRASQSISSYLNWYQQKPGKAPKLLIYVASSLQSGVPSRFSGSGSGTDFTLTISSLQPEDFATYYCQQSYSTRTFGQGTKVEIK

SEQ ID NO: 924 - protein, 8 aa, Artificial Sequence
  source: /note="Description of Artificial Sequence: Synthetic peptide"
QQSYSTRT

SEQ ID NO: 925 - protein, 125 aa, Artificial Sequence
  source: /note="Description of Artificial Sequence: Synthetic polypeptide"
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARAWAMRQTTLTPEWIDYWGQGTLVTVSS

SEQ ID NO: 926 - protein, 18 aa, Artificial Sequence
  source: /note="Description of Artificial Sequence: Synthetic peptide"
ARAWAMRQTTLTPEWIDY

SEQ ID NO: 927 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 928 - protein, 9 aa, Artificial Sequence
  source: /note="Description of Artificial Sequence: Synthetic peptide"
QQYGSSPYT

SEQ ID NO: 929 - protein, 125 aa, Artificial Sequence; identical to SEQ ID NO: 925
  source: /note="Description of Artificial Sequence: Synthetic polypeptide"

SEQ ID NO: 930 - protein, 18 aa, Artificial Sequence
  source: /note="Description of Artificial Sequence: Synthetic peptide"
ARAWAMRQTTLTPEWIDY

SEQ ID NO: 931 - protein, 106 aa, Artificial Sequence
  source: /note="Description of Artificial Sequence: Synthetic polypeptide"
SYVLTQPPSVSVSPGQTARITCSGDALPKQYAYWYQQKPGQAPVLVIYKDSERPSGIPERFSGSSSGTTVTLTISGVQAEDEADYYCQSADSRKVVFGGGTKLTVL

SEQ ID NO: 932 - protein, 9 aa, Artificial Sequence
  source: /note="Description of Artificial Sequence: Synthetic peptide"
QSADSRKVV

SEQ ID NO: 933 - protein, 126 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGVTWNSGSIGYADSVKGRFIISRDNAKNSLYLQMNSLRAEDTALYYCAKGGEGFRNWNDGLDYFDYWGQGTLVTVSS

SEQ ID NO: 934 - protein, 19 aa, Artificial Sequence
  source: /note="Description of Artificial Sequence: Synthetic peptide"
AKGGEGFRNWNDGLDYFDY

SEQ ID NO: 935 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 936 - protein, 11 aa, Artificial Sequence
  source: /note="Description of Artificial Sequence: Synthetic peptide"
AAWDDSLNGYV

SEQ ID NO: 937 - protein, 125 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGTIGYADSVKGRFTISRDNAKNSLHLHMRSLRAEDTALYYCAKDGRSGDQWPELYYFDYWGQGTLVTVSS

SEQ ID NO: 938 - protein, 18 aa, Artificial Sequence
  source: /note="Description of Artificial Sequence: Synthetic peptide"
AKDGRSGDQWPELYYFDY

SEQ ID NO: 939 - protein, 108 aa, Artificial Sequence
  source: /note="Description of Artificial Sequence: Synthetic polypeptide"
SYVLTQPPSVSVAPGKTARITCGGNDIGSNGVYWYQQKPGQAPVLVIYYDSDRPSGIPERFSGSNSGNTATLTISRVEAGDEADYYCQVWDSSSDHVVFGGGTKLTVL

SEQ ID NO: 940 - protein, 11 aa, Artificial Sequence
  source: /note="Description of Artificial Sequence: Synthetic peptide"
QVWDSSSDHVV

SEQ ID NO: 941 - protein, 126 aa, Artificial Sequence; identical to SEQ ID NO: 21
  source: /note="Description of Artificial Sequence: Synthetic polypeptide"

SEQ ID NO: 942 - protein, 19 aa, Artificial Sequence
  source: /note="Description of Artificial Sequence: Synthetic peptide"
AKAGVRGIAAAGPDLNFDH

SEQ ID NO: 943 - protein, 103 aa, Artificial Sequence; identical to SEQ ID NO: 22
  source: /note="Description of Artificial Sequence: Synthetic polypeptide"

SEQ ID NO: 944 - protein, 5 aa, Artificial Sequence
  source: /note="Description of Artificial Sequence: Synthetic peptide"
QQRIT

SEQ ID NO: 945 - protein, 121 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGITWNSGSIAYADSVKGRFTISRDNAKNSLYLQMNSLRAEDTALYYCAKGSSSSYHNWFDPWGQGTLVTVSS

SEQ ID NO: 946 - protein, 14 aa, Artificial Sequence
  source: /note="Description of Artificial Sequence: Synthetic peptide"
AKGSSSSYHNWFDP

SEQ ID NO: 947 - protein, 111 aa, Artificial Sequence
  source: /note="Description of Artificial Sequence: Synthetic polypeptide"
  MOD_RES (61)..(61): Any amino acid
QSALTQPASVSGSPGQSITISCTGTSSDIGVYNYISWSQQHPGKAPKVMIYDVTNRPSGVXNRFSGSKSGNTASLTISGLQAEDEADYYCSSYRGSSTPYVFGTGTKVTVL

SEQ ID NO: 948 - protein, 11 aa, Artificial Sequence
  source: /note="Description of Artificial Sequence: Synthetic peptide"
SSYRGSSTPYV

SEQ ID NO: 949 - protein, 120 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSVSIDYADSVKGRFTISRDNAKNSLYLQMNSLRAEDTALYYCAKDGAGTENWFDPWGQGTLVTVSS

SEQ ID NO: 950 - protein, 13 aa, Artificial Sequence
  source: /note="Description of Artificial Sequence: Synthetic peptide"
AKDGAGTENWFDP

SEQ ID NO: 951 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPLLVIYYDSDRPSGIPERFSGSNSGNTATLTISRVEAGDETDYYCQVWDSSSDPHVVFGGGTKLTV

SEQ ID NO: 952 - protein, 12 aa, Artificial Sequence
  source: /note="Description of Artificial Sequence: Synthetic peptide"
QVWDSSSDPHVV

SEQ ID NO: 953 - protein, 122 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYAHSVKGRFTISRDNAKNSLYLHMNSLRAEDTALYYCAKDMLGNYYYYAMVVWGQGTTVTVSS

SEQ ID NO: 954 - protein, 15 aa, Artificial Sequence
  source: /note="Description of Artificial Sequence: Synthetic peptide"
AKDMLGNYYYYAMVV

SEQ ID NO: 955 - protein, 112 aa, Artificial Sequence
  source: /note="Description of Artificial Sequence: Synthetic polypeptide"
QSALTQPASVSGSPGQSITISCTGTSSDVGGYNYVSWYQHHPGKAPKLMIYDVSNRPSGVSNRFSGSKSGNTASLTISGLQAEDEADYYCSSYTSSSTLEGVFGGGTKLTVL

SEQ ID NO: 956 - protein, 12 aa, Artificial Sequence
  source: /note="Description of Artificial Sequence: Synthetic peptide"
SSYTSSSTLEGV

SEQ ID NO: 957 - protein, 123 aa, Artificial Sequence; identical to SEQ ID NO: 33
  source: /note="Description of Artificial Sequence: Synthetic polypeptide"

SEQ ID NO: 958 - protein, 15 aa, Artificial Sequence
  source: /note="Description of Artificial Sequence: Synthetic peptide"
ARTMYYYDSSGSFDY

SEQ ID NO: 959 - protein, 112 aa, Artificial Sequence; identical to SEQ ID NO: 34
  source: /note="Description of Artificial Sequence: Synthetic polypeptide"

SEQ ID NO: 960 - protein, 9 aa, Artificial Sequence
  source: /note="Description of Artificial Sequence: Synthetic peptide"
MQALQTPHT

SEQ ID NO: 961 - protein, 124 aa, Artificial Sequence
  source: /note="Description of Artificial Sequence: Synthetic polypeptide"
  MOD_RES (116)..(116): Any amino acid
QVQLQESGPGLVKPSQTLSLTCTVSGGSISSGGYYWSWIRQHPGKGLEWIGYIYYSGSTYYNPSLESRVTISVDTSKNQFSLKLSSVTAADTAVYYCASGELSAFGELFPHDYWGXGTLVTVSS

SEQ ID NO: 962 - protein, 16 aa, Artificial Sequence
  source: /note="Description of Artificial Sequence: Synthetic peptide"
ASGELSAFGELFPHDY

SEQ ID NO: 963 - protein, 107 aa, Artificial Sequence
  source: /note="Description of Artificial Sequence: Synthetic polypeptide"
EIVLTQSPATLSLSPGERATLSCRASQSVSTYLAWYQQKPGQAPRLLIYDASNRATGIPARFSGSGSGTDFTLTISSLEPEDFAVYYCQQRSNWLFTFGPGTKVDIK

SEQ ID NO: 964 - protein, 9 aa, Artificial Sequence
  source: /note="Description of Artificial Sequence: Synthetic peptide"
QQRSNWLFT

SEQ ID NO: 965 - protein, 125 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSPYYNPSLKSRVTISIDTSKNQFSLKLSSVTAADTAVYYCARVHVVRGVANYPYFDYWGQGTLVTVSS

SEQ ID NO: 966 - protein, 17 aa, Artificial Sequence
  source: /note="Description of Artificial Sequence: Synthetic peptide"
ARVHVVRGVANYPYFDY

SEQ ID NO: 967 - protein, 111 aa, Artificial Sequence
  source: /note="Description of Artificial Sequence: Synthetic polypeptide"
  MOD_RES (3)..(4): Any amino acid
QSXXTQPRSVSGSPGQSVTISCTGTSSDVGGYNCVSWYQQHPGKAPKLMIYDVSKRPSGVPDRFSGSKSGNTASLTISGLQAEDEADYYCCSYAGSYTPWVFGGGTKLTVL

SEQ ID NO: 968 - protein, 11 aa, Artificial Sequence
  source: /note="Description of Artificial Sequence: Synthetic peptide"
CSYAGSYTPWV

SEQ ID NO: 969 - protein, 122 aa, Artificial Sequence
  source: /note="Description of Artificial Sequence: Synthetic polypeptide"
QVQLQESGPGLVKPSQTLSLTCTVSGGSISSGGYYWGWIRQHPGKGLEWIGYIYYSGSTYYNPSLKSRVTISVDTSKNQFSLKLSSVTAADTAVYYCARGSYSNYNGGLDYWGQGTLVTVSS

SEQ ID NO: 970 - protein, 14 aa, Artificial Sequence
  source: /note="Description of Artificial Sequence: Synthetic peptide"
ARGSYSNYNGGLDY

SEQ ID NO: 971 - protein, 110 aa, Artificial Sequence
  source: /note="Description of Artificial Sequence: Synthetic polypeptide"
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 972 - protein, 10 aa, Artificial Sequence
  source: /note="Description of Artificial Sequence: Synthetic peptide"
SSYAGSNNWV

SEQ ID NO: 973 - protein, 121 aa, Artificial Sequence
  source: /note="Description of Artificial Sequence: Synthetic polypeptide"
QVQLQESGPGLVKPSQTLSLTCTVSGGSFSSGGYYWHWIRQHPGKGLEWIGYIYYSGSTYYNPSLKSRVTISVDTSKNQFSLKLSSVTAADTAVYYCARVATDYGDSFDYWGQGTLVTVSS

SEQ ID NO: 974 - protein, 13 aa, Artificial Sequence
  source: /note="Description of Artificial Sequence: Synthetic peptide"
ARVATDYGDSFDY

SEQ ID NO: 975 - protein, 109 aa, Artificial Sequence
  source: /note="Description of Artificial Sequence: Synthetic polypeptide"
QSVLTQEPSLTVSPGGTVTLTCASSTGAVTSGYYPSWFQQKPGQAPRALIYSTSNKHSWTPARFSGSLLGGKAALTLSGVQPEDEADYYCLLYYGGAWVFGGGTKLTVL

SEQ ID NO: 976 - protein, 9 aa, Artificial Sequence
  source: /note="Description of Artificial Sequence: Synthetic peptide"
LLYYGGAWV

SEQ ID NO: 977 - protein, 126 aa, Artificial Sequence
  source: /note="Description of Artificial Sequence: Synthetic polypeptide"
QVQLQESGPGLVKPSETLSLTCTVSGGSISSYYWSWIRQPAGKGLEWIGRIYTSGSTKYNPSLKSRVTMSVDTSKNQFSLKLSSVTAADTAVYYCARAPPGDFYDSSGYFSAFDIWGQGTMVTVSS

SEQ ID NO: 978 - protein, 20 aa, Artificial Sequence
  source: /note="Description of Artificial Sequence: Synthetic peptide"
ARAPPGDFYDSSGYFSAFDI

SEQ ID NO: 979 - protein, 111 aa, Artificial Sequence; identical to SEQ ID NO: 130
  source: /note="Description of Artificial Sequence: Synthetic polypeptide"

SEQ ID NO: 980 - protein, 11 aa, Artificial Sequence
  source: /note="Description of Artificial Sequence: Synthetic peptide"
SSYRGSSTPYV

SEQ ID NO: 981 - protein, 124 aa, Artificial Sequence
  source: /note="Description of Artificial Sequence: Synthetic polypeptide"
QVQLQESGPGLVKPSETLSLTCTVSGGSISAYYWSWIRQPAGKGLEWIGRIYTSGSTIYNPSLKSRVTMSVDTSKNQFSLKLSSVTAADTAVYYCARDNGYVWGSYRPDAFDIWGQGTMVTVSS

SEQ ID NO: 982 - protein, 18 aa, Artificial Sequence
  source: /note="Description of Artificial Sequence: Synthetic peptide"
ARDNGYVWGSYRPDAFDI

SEQ ID NO: 983 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRISGSIDSSSNSASLTISGLKTEDEADYYCQSYDSRNVVFGGGTRLTVL

SEQ ID NO: 984 - protein, 9 aa, Artificial Sequence
  source: /note="Description of Artificial Sequence: Synthetic peptide"
QSYDSRNVV

SEQ ID NO: 985 - protein, 124 aa, Artificial Sequence; identical to SEQ ID NO: 981
  source: /note="Description of Artificial Sequence: Synthetic polypeptide"

SEQ ID NO: 986 - protein, 18 aa, Artificial Sequence
  source: /note="Description of Artificial Sequence: Synthetic peptide"
ARDNGYVWGSYRPDAFDI

SEQ ID NO: 987 - protein, 110 aa, Artificial Sequence; identical to SEQ ID NO: 983
  source: /note="Description of Artificial Sequence: Synthetic polypeptide"

SEQ ID NO: 988 - protein, 9 aa, Artificial Sequence
  source: /note="Description of Artificial Sequence: Synthetic peptide"
QSYDSRNVV

SEQ ID NO: 989 - protein, 123 aa, Artificial Sequence
  source: /note="Description of Artificial Sequence: Synthetic polypeptide"
QVQLQESGPGLVKPSETLSLTCTVSGGSISSYYWSWIRQPAGKGLEWIGRIYTSGSTNYNPSLESRVTMSVDTSKNQFSLKLSSVTAADTAVYYCARVVGYSSRGANYYMDVWGKGTTVTVSS

SEQ ID NO: 990 - protein, 17 aa, Artificial Sequence
  source: /note="Description of Artificial Sequence: Synthetic peptide"
ARVVGYSSRGANYYMDV

SEQ ID NO: 991 - protein, 111 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDSLFGGGTKLTVL

SEQ ID NO: 992 - protein, 11 aa, Artificial Sequence
  source: /note="Description of Artificial Sequence: Synthetic peptide"
QSYDSSLSDSL

SEQ ID NO: 993 - protein, 127 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVPSVGDCSSTSCLYWYFDLWGRGTLVTVSS

SEQ ID NO: 994 - protein, 21 aa, Artificial Sequence
  source: /note="Description of Artificial Sequence: Synthetic peptide"
ARVPSVGDCSSTSCLYWYFDL

SEQ ID NO: 995 - protein, 106 aa, Artificial Sequence
  source: /note="Description of Artificial Sequence: Synthetic polypeptide"
DIQMTQSPVSLSASVGDRVTITCRASQSISSWLAWYQQKPGKAPKLLIYKASSLESGVPSRFSGSGSGTEFTLTISSLQPDDFATYYCQQYNSYSTFGQGTKVEIK

SEQ ID NO: 996 - protein, 8 aa, Artificial Sequence
  source: /note="Description of Artificial Sequence: Synthetic peptide"
QQYNSYST

SEQ ID NO: 997 - protein, 125 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYGMGELLTLRSEYYFDYWGQGTLVTVSS

SEQ ID NO: 998 - protein, 19 aa, Artificial Sequence
  source: /note="Description of Artificial Sequence: Synthetic peptide"
ARYGMGELLTLRSEYYFDY

SEQ ID NO: 999 - protein, 110 aa, Artificial Sequence
  source: /note="Description of Artificial Sequence: Synthetic polypeptide"
QSVLTQPRSVSGSPGQSVTISCTGTSSDVGGYNYVSWYQQHPGKAPKLMIYDVSKRPSGVPDRFSGSKSGNTASLTISGLQAEDEADYYCYSYAGSYTFVFGGGTKLTVL

SEQ ID NO: 1000 - protein, 10 aa, Artificial Sequence
  source: /note="Description of Artificial Sequence: Synthetic peptide"
YSYAGSYTFV

SEQ ID NO: 1001 - protein, 122 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARSYDSSGLSYNWFDPWGQGTLVTVSS

SEQ ID NO: 1002 - protein, 16 aa, Artificial Sequence
  source: /note="Description of Artificial Sequence: Synthetic peptide"
ARSYDSSGLSYNWFDP

SEQ ID NO: 1003 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVVFGGGTKLTVL

SEQ ID NO: 1004 - protein, 12 aa, Artificial Sequence
  source: /note="Description of Artificial Sequence: Synthetic peptide"
QSYDSSLSGYVV

SEQ ID NO: 1005 - protein, 128 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGGYYYDSSGYEYYYYYGMDVWGQGTTVTVSS

SEQ ID NO: 1006 - protein, 22 aa, Artificial Sequence
  source: /note="Description of Artificial Sequence: Synthetic peptide"
ARGGYYYDSSGYEYYYYYGMDV

SEQ ID NO: 1007 - protein, 111 aa, Artificial Sequence
  source: /note="Description of Artificial Sequence: Synthetic polypeptide"
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL

SEQ ID NO: 1008 - protein, 12 aa, Artificial Sequence
  source: /note="Description of Artificial Sequence: Synthetic peptide"
AAWDDSLSGYWV

SEQ ID NO: 1009 - protein, 128 aa, Artificial Sequence
  source: /note="Description of Artificial Sequence: Synthetic polypeptide"
QVQLQESGPGLVKPSETLSLTCAVSGGSVSSGNYYWNWIRQPPGKGLEWIGYIYYSGSTNYNPSLKSRVTISVDTSKNQFSLKLNSVTAADTAVYHCARETYYYDSSGYYISDAFDIWGQGTMVTVSS

SEQ ID NO: 1010 - protein, 20 aa, Artificial Sequence
  source: /note="Description of Artificial Sequence: Synthetic peptide"
ARETYYYDSSGYYISDAFDI

SEQ ID NO: 1011 - protein, 107 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSFSYTFGQGTKLEIK

SEQ ID NO: 1012 - protein, 9 aa, Artificial Sequence
  source: /note="Description of Artificial Sequence: Synthetic peptide"
QQYNSFSYT

SEQ ID NO: 1013 - protein, 128 aa, Artificial Sequence
  source: /note="Description of Artificial Sequence: Synthetic polypeptide"
EVQLVQSGAEVKKPGESLKISCKGSGYSFSSYCIGWVRQMPGKGLEWMGIIYPGDSDTRYSPSFQGQVTISVDKSISTAYLQWSSLKASDTAMYYCARQWRGYYDRSGYYHFDAFDIWGQGTMVTVSS

SEQ ID NO: 1014 - protein, 21 aa, Artificial Sequence
  source: /note="Description of Artificial Sequence: Synthetic peptide"
ARQWRGYYDRSGYYHFDAFDI

SEQ ID NO: 1015 - protein, 107 aa, Artificial Sequence
  source: /note="Description of Artificial Sequence: Synthetic polypeptide"
EIVMTQSPATLSVSPGERATLSCRASQSVSSNLAWYQQKSGQAPRLLIYGASTRATGIPARFSGSGSGTEFTLTISSLQSEDFAVYYCQQYNNWLGTFGQGTKVEFK

SEQ ID NO: 1016 - protein, 9 aa, Artificial Sequence
  source: /note="Description of Artificial Sequence: Synthetic peptide"
QQYNNWLGT

SEQ ID NO: 1017 - protein, 126 aa, Artificial Sequence
  source: /note="Description of Artificial Sequence: Synthetic polypeptide"
EVQLVQSGAEVKKPGESLKISCKGSGYSFTTYCIGWVRQMPGKGLEWMGIIYPGDSDTRYSPSFQGQVTISADKSISTAYLQWSSLKASDTAMYYCARHWYYGDYGNYSYYYLDVWGKGTTVTVSS

SEQ ID NO: 1018 - protein, 19 aa, Artificial Sequence
  source: /note="Description of Artificial Sequence: Synthetic peptide"
ARHWYYGDYGNYSYYYLDV

SEQ ID NO: 1019 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 1020 - protein, 9 aa, Artificial Sequence
  source: /note="Description of Artificial Sequence: Synthetic peptide"
QQYNNWPLT

SEQ ID NO: 1021 - protein, 131 aa, Artificial Sequence; identical to SEQ ID NO: 125
  source: /note="Description of Artificial Sequence: Synthetic polypeptide"

SEQ ID NO: 1022 - protein, 25 aa, Artificial Sequence
  source: /note="Description of Artificial Sequence: Synthetic peptide"
AREGEVEGYNDFWSGYSRDRYYFDY

SEQ ID NO: 1023 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 1024 - protein, 10 aa, Artificial Sequence
  source: /note="Description of Artificial Sequence: Synthetic peptide"
SSYTSSSTRV

SEQ ID NO: 1025 - protein, 131 aa, Artificial Sequence; identical to SEQ ID NO: 127
  source: /note="Description of Artificial Sequence: Synthetic polypeptide"

SEQ ID NO: 1026 - protein, 25 aa, Artificial Sequence
  source: /note="Description of Artificial Sequence: Synthetic peptide"
AREGEVEGYYDFWSGYSRDRYYFDY

SEQ ID NO: 1027 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSTTRVFGTGTRVTVL

SEQ ID NO: 1028 - protein, 10 aa, Artificial Sequence
  source: /note="Description of Artificial Sequence: Synthetic peptide"
SSYTSSTTRV

SEQ ID NO: 1029 - protein, 131 aa, Artificial Sequence
  source: /note="Description of Artificial Sequence: Synthetic polypeptide"
EVQLVESGGGLIQPGGSLRLSCAASGFTVSNNYMSWVRQAPGKGLEWVSVIYSGGSTYYADSLKGRFTISRDNSKNTLYLQMNSLRAEDTAVYYCAREGEVEGYYDFWSGYSRDRYYFDYWGQGTLVTVSS

SEQ ID NO: 1030 - protein, 25 aa, Artificial Sequence
  source: /note="Description of Artificial Sequence: Synthetic peptide"
AREGEVEGYYDFWSGYSRDRYYFDY

SEQ ID NO: 1031 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSISTRVFGTGTKVTVL

SEQ ID NO: 1032 - protein, 10 aa, Artificial Sequence
  source: /note="Description of Artificial Sequence: Synthetic peptide"
SSYTSISTRV

SEQ ID NO: 1033 - protein, 131 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGDVEGYYDFWSGYSRDRYYFDYWGQGTLVTVSS

SEQ ID NO: 1034 - protein, 25 aa, Artificial Sequence
  source: /note="Description of Artificial Sequence: Synthetic peptide"
AREGDVEGYYDFWSGYSRDRYYFDY

SEQ ID NO: 1035 - protein, 110 aa, Artificial Sequence; identical to SEQ ID NO: 126
  source: /note="Description of Artificial Sequence: Synthetic polypeptide"

SEQ ID NO: 1036 - protein, 10 aa, Artificial Sequence
  source: /note="Description of Artificial Sequence: Synthetic peptide"
SSYTSSSTRV

SEQ ID NO: 1037 - protein, 131 aa, Artificial Sequence
  source: /note="Description of Artificial Sequence: Synthetic polypeptide"
EVQLVESGGGLIQPGGSLRLSCAASGFTVRNNYMSWVRQAPGKGLEWVSVIYSGGSTYYADSVKGRFTISRDNSKNTLYLQMNSLRAEDTAVYYCAREGEVEGYYDFWSGYSRDRYYFDYWGQGTLVTVSS

SEQ ID NO: 1038 - protein, 25 aa, Artificial Sequence
  source: /note="Description of Artificial Sequence: Synthetic peptide"
AREGEVEGYYDFWSGYSRDRYYFDY

SEQ ID NO: 1039 - protein, 110 aa, Artificial Sequence; identical to SEQ ID NO: 126
  source: /note="Description of Artificial Sequence: Synthetic polypeptide"

SEQ ID NO: 1040 - protein, 10 aa, Artificial Sequence
  source: /note="Description of Artificial Sequence: Synthetic peptide"
SSYTSSSTRV

SEQ ID NO: 1041 - protein, 131 aa, Artificial Sequence; identical to SEQ ID NO: 127
  source: /note="Description of Artificial Sequence: Synthetic polypeptide"

SEQ ID NO: 1042 - protein, 25 aa, Artificial Sequence
  source: /note="Description of Artificial Sequence: Synthetic peptide"
AREGEVEGYYDFWSGYSRDRYYFDY

SEQ ID NO: 1043 - protein, 110 aa, Artificial Sequence; identical to SEQ ID NO: 1027
  source: /note="Description of Artificial Sequence: Synthetic polypeptide"

SEQ ID NO: 1044 - protein, 10 aa, Artificial Sequence
  source: /note="Description of Artificial Sequence: Synthetic peptide"
SSYTSSTTRV

SEQ ID NO: 1045 - protein, 129 aa, Artificial Sequence [sequence omitted]

SEQ ID NO: 1046 - protein, 23 aa, Artificial Sequence
  source: /note="Description of Artificial Sequence: Synthetic peptide"
ARDSSEVRDHPGHPGRSVGAFDI

SEQ ID NO: 1047 - protein, 110 aa, Artificial Sequence
  source: /note="Description of Artificial Sequence: Synthetic polypeptide"
QSVLTQPASVSGSPGQSITISCTGTSNDVGSYTLVSWYQQYPGKAPKLLIFEGTKRSSGISNRFSGSKSGNTASLTISGLQGEDEADYYCCSYAGASTFVFGGGTKLTVL

SEQ ID NO: 1048 - protein, 10 aa, Artificial Sequence
  source: /note="Description of Artificial Sequence: Synthetic peptide"
CSYAGASTFV

SEQ ID NO: 1049 - protein, 129 aa, Artificial Sequence
  source: /note="Description of Artificial Sequence: Synthetic polypeptide"
EVQLVESGGGLVQPGGSLRLSCAASGFSVSTKYMTWVRQAPGKGLEWVSVLYSGGSDYYADSVKGRFTISRDNSKNALYLQMSSLRVEDTGIYYCARDSSEVRDHPGHPGRSVGAFDIWGQGTMVTVSS

SEQ ID NO: 1050 - protein, 23 aa, Artificial Sequence
  source: /note="Description of Artificial Sequence: Synthetic peptide"
ARDSSEVRDHPGHPGRSVGAFDI

SEQ ID NO: 1051 - protein, 110 aa, Artificial Sequence; identical to SEQ ID NO: 1047
  source: /note="Description of Artificial Sequence: Synthetic polypeptide"

SEQ ID NO: 1052 - protein, 10 aa, Artificial Sequence
  source: /note="Description of Artificial Sequence: Synthetic peptide"
CSYAGASTFV

SEQ ID NO: 1053 - protein, 129 aa, Artificial Sequence; identical to SEQ ID NO: 1049
  source: /note="Description of Artificial Sequence: Synthetic polypeptide"

SEQ ID NO: 1054 - protein, 23 aa, Artificial Sequence
  source: /note="Description of Artificial Sequence: Synthetic peptide"
ARDSSEVRDHPGHPGRSVGAFDI

SEQ ID NO: 1055 - protein, 110 aa, Artificial Sequence; identical to SEQ ID NO: 124
  source: /note="Description of Artificial Sequence: Synthetic polypeptide"

SEQ ID NO: 1056 - protein, 10 aa, Artificial Sequence
  source: /note="Description of Artificial Sequence: Synthetic peptide"
CSYAGASTFV

SEQ ID NO: 1057 - protein, 129 aa, Artificial Sequence [sequence omitted]

SEQ ID NO: 1058 - protein, 23 aa, Artificial Sequence
  source: /note="Description of Artificial Sequence: Synthetic peptide"
ARDSSEVRDHPGHPGRSVGAFDI

SEQ ID NO: 1059 - protein, 110 aa, Artificial Sequence; identical to SEQ ID NO: 1047
  source: /note="Description of Artificial Sequence: Synthetic polypeptide"

SEQ ID NO: 1060 - protein, 10 aa, Artificial Sequence
  source: /note="Description of Artificial Sequence: Synthetic peptide"
CSYAGASTFV

SEQ ID NO: 1061 - protein, 130 aa, Artificial Sequence; identical to SEQ ID NO: 141
  source: /note="Description of Artificial Sequence: Synthetic polypeptide"

SEQ ID NO: 1062 - protein, 23 aa, Artificial Sequence
  source: /note="Description of Artificial Sequence: Synthetic peptide"
ARDRGGHDFWSGYGFYYYYGMDV

SEQ ID NO: 1063 - protein, 107 aa, Artificial Sequence; identical to SEQ ID NO: 142
  source: /note="Description of Artificial Sequence: Synthetic polypeptide"

SEQ ID NO: 1064 - protein, 9 aa, Artificial Sequence
  source: /note="Description of Artificial Sequence: Synthetic peptide"
QKYNSAPRT

SEQ ID NO: 1065 - protein, 130 aa, Artificial Sequence
  source: /note="Description of Artificial Sequence: Synthetic polypeptide"
QVQLVQSGAEVKKPGASVKVSCKASGYNFTSYGISWVRQAPGQGLEWMGWISGYNGNTNYGQKFQGGVTMTTDTSTSTAYMELRSLRSDDTAVYYCARDRGGHNFWSGYGYYYYYGMDVWGQGTTVTVSS

SEQ ID NO: 1066 - protein, 23 aa, Artificial Sequence
  source: /note="Description of Artificial Sequence: Synthetic peptide"
ARDRGGHNFWSGYGYYYYYGMDV

SEQ ID NO: 1067 - protein, 107 aa, Artificial Sequence
  source: /note="Description of Artificial Sequence: Synthetic polypeptide"
  MOD_RES (12)..(12): Any amino acid
DIQMTQSPSSLXASVGDRVTITCRASQGISNYLAWYQQKPGKVPKLLIYAASTLQSGVPSRFSGSESGTDFTLTISSLQPEDVATYYCQKYNSAPRTFGQGTKVEIK

SEQ ID NO: 1068 - protein, 9 aa, Artificial Sequence
  source: /note="Description of Artificial Sequence: Synthetic peptide"
QKYNSAPRT

SEQ ID NO: 1069 - protein, 122 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARERGYYGGKTPPFLGGQGTLVTVSS

SEQ ID NO: 1070 - protein, 15 aa, Artificial Sequence
  source: /note="Description of Artificial Sequence: Synthetic peptide"
ARERGYYGGKTPPFL

SEQ ID NO: 1071 - protein, 111 aa, Artificial Sequence; identical to SEQ ID NO: 140
  source: /note="Description of Artificial Sequence: Synthetic polypeptide"

SEQ ID NO: 1072 - protein, 10 aa, Artificial Sequence
  source: /note="Description of Artificial Sequence: Synthetic peptide"
QSYDSSNYWV

SEQ ID NO: 1073 - protein, 122 aa, Artificial Sequence; identical to SEQ ID NO: 139
  source: /note="Description of Artificial Sequence: Synthetic polypeptide"

SEQ ID NO: 1074 - protein, 15 aa, Artificial Sequence
  source: /note="Description of Artificial Sequence: Synthetic peptide"
ARERGYDGGKTPPFL

SEQ ID NO: 1075 - protein, 111 aa, Artificial Sequence; identical to SEQ ID NO: 140
  source: /note="Description of Artificial Sequence: Synthetic polypeptide"

SEQ ID NO: 1076 - protein, 10 aa, Artificial Sequence
  source: /note="Description of Artificial Sequence: Synthetic peptide"
QSYDSSNYWV

SEQ ID NO: 1077 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVTSYDGTNKYYADSVKGRFTISRDNSKNTLYLQMNSLRAEDTAVYFCAKNVGTGYNVMYYFDYWGQGTLVTVSS

SEQ ID NO: 1078 - protein, 16 aa, Artificial Sequence
  source: /note="Description of Artificial Sequence: Synthetic peptide"
AKNVGTGYNVMYYFDY

SEQ ID NO: 1079 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDTSNLERGVPSRFSGSGSGSDFTFTISSLQPEDIATYYCQQYDNLPITFGQGTRLEIK

SEQ ID NO: 1080 - protein, 9 aa, Artificial Sequence
  source: /note="Description of Artificial Sequence: Synthetic peptide"
QQYDNLPIT

SEQ ID NO: 1081 - protein, 127 aa, Artificial Sequence; identical to SEQ ID NO: 145
  source: /note="Description of Artificial Sequence: Synthetic polypeptide"

SEQ ID NO: 1082 - protein, 20 aa, Artificial Sequence
  source: /note="Description of Artificial Sequence: Synthetic peptide"
AKQAGPYCSGGSCYSAPFDY

SEQ ID NO: 1083 - protein, 107 aa, Artificial Sequence; identical to SEQ ID NO: 146
  source: /note="Description of Artificial Sequence: Synthetic polypeptide"

SEQ ID NO: 1084 - protein, 9 aa, Artificial Sequence
  source: /note="Description of Artificial Sequence: Synthetic peptide"
QQYDNLPIT

SEQ ID NO: 1085 - protein, 125 aa, Artificial Sequence
  source: /note="Description of Artificial Sequence: Synthetic polypeptide"
QVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKVGLGYSSGWYGEEIDYWGQGTLVTVSS

SEQ ID NO: 1086 - protein, 18 aa, Artificial Sequence
  source: /note="Description of Artificial Sequence: Synthetic peptide"
AKVGLGYSSGWYGEEIDY

SEQ ID NO: 1087 - protein, 107 aa, Artificial Sequence
  source: /note="Description of Artificial Sequence: Synthetic polypeptide"
DIQMTQSPSSLSASVGDRVTITCRASQSISSFLNWYQQKPGKAPNLLIYAASSLQSGVPSRFSGSGSGTDFTLTISSLQPEDFATYYCQQSYRTPLTFGGGTKVEIK

SEQ ID NO: 1088 - protein, 9 aa, Artificial Sequence
  source: /note="Description of Artificial Sequence: Synthetic peptide"
QQSYRTPLT

SEQ ID NO: 1089 - protein, 125 aa, Artificial Sequence; identical to SEQ ID NO: 135
  source: /note="Description of Artificial Sequence: Synthetic polypeptide"

SEQ ID NO: 1090 - protein, 18 aa, Artificial Sequence
  source: /note="Description of Artificial Sequence: Synthetic peptide"
AKVGMEYSSGWYGEEIDF

SEQ ID NO: 1091 - protein, 107 aa, Artificial Sequence; identical to SEQ ID NO: 136
  source: /note="Description of Artificial Sequence: Synthetic polypeptide"

SEQ ID NO: 1092 - protein, 9 aa, Artificial Sequence
  source: /note="Description of Artificial Sequence: Synthetic peptide"
QQSYRTPLT

SEQ ID NO: 1093 - protein, 124 aa, Artificial Sequence; identical to SEQ ID NO: 149
  source: /note="Description of Artificial Sequence: Synthetic polypeptide"

SEQ ID NO: 1094 - protein, 17 aa, Artificial Sequence
  source: /note="Description of Artificial Sequence: Synthetic peptide"
AKDPFPLAVAGTGYFDY

SEQ ID NO: 1095 - protein, 108 aa, Artificial Sequence
  source: /note="Description of Artificial Sequence: Synthetic polypeptide"
SYVLTQPPSVSVAPGQTARISCGGNNIGSKNVHWYQQKPGQAPVLVVYDDSDRPSGIPERFSGSNSGNTATLTISRVEAGDEADYYCQVWDSSSDPWVFGGGTKLTVL

SEQ ID NO: 1096 - protein, 11 aa, Artificial Sequence
  source: /note="Description of Artificial Sequence: Synthetic peptide"
QVWDSSSDPWV

SEQ ID NO: 1097 - protein, 122 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKHYADSVKGRFTISRDNSKNTLYLQMNSLRAEDTAVYYCAKDPWELRQGNYFDYWGQGTLVTVSS

SEQ ID NO: 1098 - protein, 15 aa, Artificial Sequence
  source: /note="Description of Artificial Sequence: Synthetic peptide"
AKDPWELRQGNYFDY

SEQ ID NO: 1099 - protein, 108 aa, Artificial Sequence
  source: /note="Description of Artificial Sequence: Synthetic polypeptide"
SYVLTQPPSVSVAPGQTARITCGGNNIGSKNVHWYQQKPGQAPVLVVYDDSDRPSGIPERFSGSNSGTTATLTISRVEAGDEADYYCQVWDSSSDPWVFGGGTKLTVL

SEQ ID NO: 1100 - protein, 11 aa, Artificial Sequence
  source: /note="Description of Artificial Sequence: Synthetic peptide"
QVWDSSSDPWV

SEQ ID NO: 1101 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDYGDYYFDYWGQGTLVTVSS

SEQ ID NO: 1102 - protein, 11 aa, Artificial Sequence
  source: /note="Description of Artificial Sequence: Synthetic peptide"
ARDYGDYYFDY

SEQ ID NO: 1103 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK

SEQ ID NO: 1104 - protein, 9 aa, Artificial Sequence
  source: /note="Description of Artificial Sequence: Synthetic peptide"
QQYNNWPRT

SEQ ID NO: 1105 - protein, 117 aa, Artificial Sequence; identical to SEQ ID NO: 147
  source: /note="Description of Artificial Sequence: Synthetic polypeptide"

SEQ ID NO: 1106 - protein, 11 aa, Artificial Sequence
  source: /note="Description of Artificial Sequence: Synthetic peptide"
ARDFGEFYFDY

SEQ ID NO: 1107 - protein, 107 aa, Artificial Sequence; identical to SEQ ID NO: 148
  source: /note="Description of Artificial Sequence: Synthetic polypeptide"

SEQ ID NO: 1108 - protein, 9 aa, Artificial Sequence
  source: /note="Description of Artificial Sequence: Synthetic peptide"
QQYNNWPRT

SEQ ID NO: 1109 - protein, 129 aa, Artificial Sequence [sequence omitted]

SEQ ID NO: 1110 - protein, 23 aa, Artificial Sequence
  source: /note="Description of Artificial Sequence: Synthetic peptide"
ARDSSEVRDHPGHPGRSVGAFDI

SEQ ID NO: 1111 - protein, 110 aa, Artificial Sequence
  source: /note="Description of Artificial Sequence: Synthetic polypeptide"
QSVLTQPASVSGSPGQSITISCTGTSNDVGSYTLVSWYQQYPGKAPKLLIFEVTKRSSGISNRFSGSKSGNTASLTISGLQGEDEADYYCCSYAGASTFVFGGGTKLTVL

SEQ ID NO: 1112 - protein, 10 aa, Artificial Sequence
  source: /note="Description of Artificial Sequence: Synthetic peptide"
CSYAGASTFV

SEQ ID NO: 1113 - protein, 129 aa, Artificial Sequence
  source: /note="Description of Artificial Sequence: Synthetic polypeptide"
EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMVTVSS

SEQ ID NO: 1114 - protein, 23 aa, Artificial Sequence
  source: /note="Description of Artificial Sequence: Synthetic peptide"
ARDSSEVRDHPGHPGRSVGAFDI

SEQ ID NO: 1115 - protein, 110 aa, Artificial Sequence
  source: /note="Description of Artificial Sequence: Synthetic polypeptide"
QSALTQPASVSGSPGQSITISCTGTSNDVGSYTLVSWYQQYPGKAPKLLIFEDTKRSSGISNRFSGSKSGNTASLTISGLQGEDEADYYCCSYAGTSTFVFGGGTKLTVL

SEQ ID NO: 1116 - protein, 10 aa, Artificial Sequence
  source: /note="Description of Artificial Sequence: Synthetic peptide"
CSYAGTSTFV

SEQ ID NO: 1117 - protein, 115 aa, Artificial Sequence; identical to SEQ ID NO: 133
  source: /note="Description of Artificial Sequence: Synthetic polypeptide"

SEQ ID NO: 1118 - protein, 9 aa, Artificial Sequence
  source: /note="Description of Artificial Sequence: Synthetic peptide"
ARIANYMDV

SEQ ID NO: 1119 - protein, 108 aa, Artificial Sequence; identical to SEQ ID NO: 134
  source: /note="Description of Artificial Sequence: Synthetic polypeptide"

SEQ ID NO: 1120 - protein, 10 aa, Artificial Sequence
  source: /note="Description of Artificial Sequence: Synthetic peptide"
QQYNNWPPLT

SEQ ID NO: 1121 - protein, 115 aa, Artificial Sequence
  source: /note="Description of Artificial Sequence: Synthetic polypeptide"
EVQLVESGGGLVQPGGSQRLSCAASGFTVSSNYMSWIRQAPGKGLEWVSVIYSGGSAYYVDSVKGRFTISRDNSKNTLYLQMNSLRAEDTAVYYCARIANYMDVWGKGTTVTVSS

SEQ ID NO: 1122 - protein, 9 aa, Artificial Sequence
  source: /note="Description of Artificial Sequence: Synthetic peptide"
ARIANYMDV

SEQ ID NO: 1123 - protein, 108 aa, Artificial Sequence; identical to SEQ ID NO: 134
  source: /note="Description of Artificial Sequence: Synthetic polypeptide"

SEQ ID NO: 1124 - protein, 10 aa, Artificial Sequence
  source: /note="Description of Artificial Sequence: Synthetic peptide"
QQYNNWPPLT

SEQ ID NO: 1125 - protein, 120 aa, Artificial Sequence; identical to SEQ ID NO: 131
  source: /note="Description of Artificial Sequence: Synthetic polypeptide"

SEQ ID NO: 1126 - protein, 13 aa, Artificial Sequence
  source: /note="Description of Artificial Sequence: Synthetic peptide"
ARLSDRWYSPFDP

SEQ ID NO: 1127 - protein, 110 aa, Artificial Sequence
  source: /note="Description of Artificial Sequence: Synthetic polypeptide"
QSVLTQEPSLTVSPGGTVTLTCGSSTGAVTSGHYPYWFQQKSGQAPRTLIYETSIKHSWTPARFSGSLLGGKAALTLSGAQPEDEADYYCLLSYSGARPVFGGGTKLTVL

SEQ ID NO: 1128 - protein, 10 aa, Artificial Sequence
  source: /note="Description of Artificial Sequence: Synthetic peptide"
LLSYSGARPV

SEQ ID NO: 1129 - protein, 120 aa, Artificial Sequence; identical to SEQ ID NO: 131
  source: /note="Description of Artificial Sequence: Synthetic polypeptide"

SEQ ID NO: 1130 - protein, 13 aa, Artificial Sequence
  source: /note="Description of Artificial Sequence: Synthetic peptide"
ARLSDRWYSPFDP

SEQ ID NO: 1131 - protein, 110 aa, Artificial Sequence; identical to SEQ ID NO: 1127
  source: /note="Description of Artificial Sequence: Synthetic polypeptide"

SEQ ID NO: 1132 - protein, 10 aa, Artificial Sequence
  source: /note="Description of Artificial Sequence: Synthetic peptide"
LLSYSGARPV

SEQ ID NO: 1133 - protein, 129 aa, Artificial Sequence
  source: /note="Description of Artificial Sequence: Synthetic polypeptide"
QVQLVQSGAEVKKPGASVKVSCKASGYTFTSYNITWVRQAPGQGLEWVGWISAYNGNTNYAQKFQGRVTMTTDTSTSTAYMELRSLRSDDTAVYYCARVPRGYYDRSGYYYLPHYLDYWGQGTLVTVSS

SEQ ID NO: 1134 - protein, 22 aa, Artificial Sequence
  source: /note="Description of Artificial Sequence: Synthetic peptide"
ARVPRGYYDRSGYYYLPHYLDY

SEQ ID NO: 1135 - protein, 108 aa, Artificial Sequence
  source: /note="Description of Artificial Sequence: Synthetic polypeptide"
DIQMTQSPSSLSASVGDRVTITCQASQDISNYLNWYQQKPGKPPKLLIYDASNLETGVPSRFSGSGSGTDFIFSISSLQPEDIATYYCQQYDSLPGCSFGQGTKLEIK

SEQ ID NO: 1136 - protein, 10 aa, Artificial Sequence
  source: /note="Description of Artificial Sequence: Synthetic peptide"
QQYDSLPGCS

SEQ ID NO: 1137 - protein, 125 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSAYSGYDFFEAPRDYWGQGTLVTVSS

SEQ ID NO: 1138 - protein, 18 aa, Artificial Sequence
  source: /note="Description of Artificial Sequence: Synthetic peptide"
ARDSAYSGYDFFEAPRDY

SEQ ID NO: 1139 - protein, 106 aa, Artificial Sequence
  source: /note="Description of Artificial Sequence: Synthetic polypeptide"
DIQMTQSPSSLSASVGDRVTITCRASQSISSFLNWYQQKPGKAPKLLIYAASSLHSGVPSRFSGSGSGTDFTLTISSLQPEDFATYYCQQSYRTPPLFGGGTKVEI

SEQ ID NO: 1140 - protein, 9 aa, Artificial Sequence
  source: /note="Description of Artificial Sequence: Synthetic peptide"
QQSYRTPPL

SEQ ID NO: 1141 - protein, 120 aa, Artificial Sequence
  source: /note="Description of Artificial Sequence: Synthetic polypeptide"
QVQLVQSGAEVKKPGASVKVSCKASGYTFTSYDISWVRQAPGQGLEWMGWINAYNGNTNYAQKLQGRVTMTTDTSTSTAYMELRSLRSDDTAVYYCARPSSSLTSYFDYWGQGTLVTVSS

SEQ ID NO: 1142 - protein, 13 aa, Artificial Sequence
  source: /note="Description of Artificial Sequence: Synthetic peptide"
ARPSSSLTSYFDY

SEQ ID NO: 1143 - protein, 109 aa, Artificial Sequence
  source: /note="Description of Artificial Sequence: Synthetic polypeptide"
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDRHWVFGGGTKLTVL

SEQ ID NO: 1144 - protein, 12 aa, Artificial Sequence
  source: /note="Description of Artificial Sequence: Synthetic peptide"
QVWDSSSDRHWV

SEQ ID NO: 1145 - protein, 127 aa, Artificial Sequence; identical to SEQ ID NO: 151
  source: /note="Description of Artificial Sequence: Synthetic polypeptide"

SEQ ID NO: 1146 - protein, 20 aa, Artificial Sequence
  source: /note="Description of Artificial Sequence: Synthetic peptide"
ARVPASYGDDDYYYYYGMDV

SEQ ID NO: 1147 - protein, 108 aa, Artificial Sequence
  source: /note="Description of Artificial Sequence: Synthetic polypeptide"
SYVLTQPPSVSVSPGQTARITCSGDALPKQYAYWYQQKPGQAPVLVIYKDSERPSGIPERFSGSSSGTTVTLTISGVQAEDEADYYCQSADSSGTLWVFGGGTKLTVL

SEQ ID NO: 1148 - protein, 11 aa, Artificial Sequence
  source: /note="Description of Artificial Sequence: Synthetic peptide"
QSADSSGTLWV

SEQ ID NO: 1149 - protein, 130 aa, Artificial Sequence
  source: /note="Description of Artificial Sequence: Synthetic polypeptide"
QVQLVQSGAEVKKPGASVKVSCKASGYIFTDYSMHWVRQAPGQGLEWIGWVNPNSGGTNYAQKFQGWVTMARDTSITTVYMELSRLKSDDTAVYFCARGPLFHRLVYDFWSGYHDGFDMWGQGTMVTVSS

SEQ ID NO: 1150 - protein, 23 aa, Artificial Sequence
  source: /note="Description of Artificial Sequence: Synthetic peptide"
ARGPLFHRLVYDFWSGYHDGFDM

SEQ ID NO: 1151 - protein, 110 aa, Artificial Sequence
  source: /note="Description of Artificial Sequence: Synthetic polypeptide"
QSVLTQPASVSGSPGQSITISCTGTSSDVGGYKFVSWYQQHPGKAPKLMIYEVSNRPSGVSNRFSGSKSGNTASLTISGLQAEDEADYYCNSYTSSSTWVFGGGTKLTVL

SEQ ID NO: 1152 - protein, 10 aa, Artificial Sequence
  source: /note="Description of Artificial Sequence: Synthetic peptide"
NSYTSSSTWV

SEQ ID NO: 1153 - protein, 131 aa, Artificial Sequence
  source: /note="Description of Artificial Sequence: Synthetic polypeptide"
QVQLVQSGAEVKKPGASVKVSCKASGYTFTGYYLHWVRQAPGQGLEWMGWINPNSGGTNYAQKFQGWVTMTRDTSISTAYMELSRLRSDDTAVYYCARTPRVYDPTLPNQWLVGEYYCDYWGQGTLVTVSS

SEQ ID NO: 1154 - protein, 24 aa, Artificial Sequence
  source: /note="Description of Artificial Sequence: Synthetic peptide"
ARTPRVYDPTLPNQWLVGEYYCDY

SEQ ID NO: 1155 - protein, 110 aa, Artificial Sequence
  source: /note="Description of Artificial Sequence: Synthetic polypeptide"
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL

SEQ ID NO: 1156 - protein, 10 aa, Artificial Sequence
  source: /note="Description of Artificial Sequence: Synthetic peptide"
CSYAGSYTWV

SEQ ID NO: 1157 - protein, 122 aa, Artificial Sequence
  source: /note="Description of Artificial Sequence: Synthetic polypeptide"
QVQLVQSGAEVKKPGASVKVSCKASGYTFTGYYIHWVRQAPGQGLEWMGWINPNSGGTKYAQKFQGWVTMTRDTSITTVYMELSRLRSDDTAVYYCARGTEYNWNSAHFDPWGQGTLVTVSS

SEQ ID NO: 1158 - protein, 15 aa, Artificial Sequence
  source: /note="Description of Artificial Sequence: Synthetic peptide"
ARGTEYNWNSAHFDP

SEQ ID NO: 1159 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTSWVFGGGTKLTVL

SEQ ID NO: 1160 - protein, 11 aa, Artificial Sequence
  source: /note="Description of Artificial Sequence: Synthetic peptide"
SSYTSSSTSWV

SEQ ID NO: 1161 - protein, 120 aa, Artificial Sequence
  source: /note="Description of Artificial Sequence: Synthetic polypeptide"
QVQLVQSGAEVKKPGASVKVSCMASGYTLTAYYIHWVRQAPGQGLESLGWINPRTGGTTILQKFQGWVTMTRDTSINTVYLELPRVTLADTAVYYCVRGGTWNYVGGEVWGQGTAVTVSS

SEQ ID NO: 1162 - protein, 13 aa, Artificial Sequence
  source: /note="Description of Artificial Sequence: Synthetic peptide"
VRGGTWNYVGGEV

SEQ ID NO: 1163 - protein, 111 aa, Artificial Sequence
  source: /note="Description of Artificial Sequence: Synthetic polypeptide"
QSALTQPASVSGSPGQSITVSCAGSSTDVGGYNFVSWYQHHPGRVPKLIIYEVNNRPSGVSVRFSGSKSGNTASLTISGLQAEDEADYYCTSFTSSSDSWIFGGGTKLTVL

SEQ ID NO: 1164 - protein, 11 aa, Artificial Sequence
  source: /note="Description of Artificial Sequence: Synthetic peptide"
TSFTSSSDSWI

SEQ ID NO: 1165 - protein, 121 aa, Artificial Sequence
  source: /note="Description of Artificial Sequence: Synthetic polypeptide"
QVQLVQSGAEVKKPGASVKVSCKASGYTFTSHYMHWVRQAPGQGLEWMGIINPSGGGTSYAQKFQGRVTMTRDTSMSTVYMELSSLRSEDTAVYYCASSSSTPDYYGMDVWGQGTTVTVSS

SEQ ID NO: 1166 - protein, 14 aa, Artificial Sequence
  source: /note="Description of Artificial Sequence: Synthetic peptide"
ASSSSTPDYYGMDV

SEQ ID NO: 1167 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYGASTLQSGVPSRFSGSGSGTEFTLTISSLQPEDFATYYCQQLNSYPLCSFGQGTKLEIK

SEQ ID NO: 1168 - protein, 10 aa, Artificial Sequence
  source: /note="Description of Artificial Sequence: Synthetic peptide"
QQLNSYPLCS

SEQ ID NO: 1169 - protein, 125 aa, Artificial Sequence
  source: /note="Description of Artificial Sequence: Synthetic polypeptide"
QVQLVQSGAEVKKPGASVKVSCKASGYTFTSYYIHWVRQAPGQGLEWMGIINPSDGGTSYAQKFQGRVTMTRDTSTSTVYMELSSLRSEDTAVYSCARASTSTTNWNDALSLGCWGQGTLVTVSS

SEQ ID NO: 1170 - protein, 18 aa, Artificial Sequence
  source: /note="Description of Artificial Sequence: Synthetic peptide"
ARASTSTTNWNDALSLGC

SEQ ID NO: 1171 - protein, 113 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSGLSGSGVVFGGGTKLTVL

SEQ ID NO: 1172 - protein, 13 aa, Artificial Sequence
  source: /note="Description of Artificial Sequence: Synthetic peptide"
QSYDSGLSGSGVV

SEQ ID NO: 1173 - protein, 131 aa, Artificial Sequence
  source: /note="Description of Artificial Sequence: Synthetic polypeptide"
QVQLVQSGAEVKKPGASVKVSCKASGYTFTTYYMHWVRQAPGQGLEWMGIINPSGGSTSYAQKFQGRVTMTRDTSTSTVYMELNSLRSEDTAVYYCARGGSSRYCSSTSCYSFGVDNFDYWGQGTLVTVSS

SEQ ID NO: 1174 - protein, 24 aa, Artificial Sequence
  source: /note="Description of Artificial Sequence: Synthetic peptide"
ARGGSSRYCSSTSCYSFGVDNFDY

SEQ ID NO: 1175 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVVYDDGDRPSGIPERFSGSNSGNTATLTISRVEAGDEADYYCQVWDSSSDHYYVFGTGTKVTVL

SEQ ID NO: 1176 - protein, 12 aa, Artificial Sequence
  source: /note="Description of Artificial Sequence: Synthetic peptide"
QVWDSSSDHYYV

SEQ ID NO: 1177 - protein, 118 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARVGYGYYFDYWGQGTLVTVSS

SEQ ID NO: 1178 - protein, 11 aa, Artificial Sequence
  source: /note="Description of Artificial Sequence: Synthetic peptide"
ARVGYGYYFDY

SEQ ID NO: 1179 - protein, 106 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPSFGQGTKLEIK

SEQ ID NO: 1180 - protein, 8 aa, Artificial Sequence
  source: /note="Description of Artificial Sequence: Synthetic peptide"
QQRSNWPS

SEQ ID NO: 1181 - protein, 125 aa, Artificial Sequence
  source: /note="Description of Artificial Sequence: Synthetic polypeptide"
QVQLVQSGAEVKKPGSSVKVSCKASGGTFSSDAISWVRQAPGQGLEWMGGIMPIFGTANYAQKFQGRVTITADESTSTAYMELSSLRSEDTAVYYCARDLRYCSGGRCLWWFDPWGQGTLVTVSS

SEQ ID NO: 1182 - protein, 18 aa, Artificial Sequence
  source: /note="Description of Artificial Sequence: Synthetic peptide"
ARDLRYCSGGRCLWWFDP

SEQ ID NO: 1183 - protein, 107 aa, Artificial Sequence
  source: /note="Description of Artificial Sequence: Synthetic polypeptide"
DIQMTQSPSSLSASVGDRVTITCRASQSINNYLNWYQQKPGKAPKLLIYAASSLQSGVPSRFSGSGSGTDFTLTISSLQPEDFATYYCQQSYSTPRTFGPGTKVDIK

SEQ ID NO: 1184 - protein, 9 aa, Artificial Sequence
  source: /note="Description of Artificial Sequence: Synthetic peptide"
QQSYSTPRT

SEQ ID NO: 1185 - protein, 128 aa, Artificial Sequence
  source: /note="Description of Artificial Sequence: Synthetic polypeptide"
QVQLVQSGAEVKKPGSSVKVSCKASGGTFSSNYAISWVRQAPGQGLEWMGGIIPIFGTANYAQKLQGRVTITTDESTSTAYMELSSLRSEDTAVYYCARYTYYYDRSGYYRPDYFDYWGQGTLVTVSS

SEQ ID NO: 1186 - protein, 20 aa, Artificial Sequence
  source: /note="Description of Artificial Sequence: Synthetic peptide"
ARYTYYYDRSGYYRPDYFDY

SEQ ID NO: 1187 - protein, 107 aa, Artificial Sequence
  source: /note="Description of Artificial Sequence: Synthetic polypeptide"
AIQLTQSPSSLSASVGDRVTITCRASQGISTVLAWYQQKPGKTPKLLIYDASSLESGAPSRFSGSGSGTDFTLTISSLQPEDFATYYCQQFNSYQLTFGGGTKVEIK

SEQ ID NO: 1188 - protein, 9 aa, Artificial Sequence
  source: /note="Description of Artificial Sequence: Synthetic peptide"
QQFNSYQLT

SEQ ID NO: 1189 - protein, 122 aa, Artificial Sequence
  source: /note="Description of Artificial Sequence: Synthetic polypeptide"
EVQLVESGGGLVKPGGSLRLSCAASGFTFSSAWMSWVRQAPGKGLEWVGRIKTKTDGGTKDYAAPVKGRFTISRDDSKNTLYLQMNSLKTEDTAVYYCTTTNDYGDYSPAYWGQGTLVTVSS

SEQ ID NO: 1190 - protein, 13 aa, Artificial Sequence
  source: /note="Description of Artificial Sequence: Synthetic peptide"
TTTNDYGDYSPAY

SEQ ID NO: 1191 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTAFTLTISSLQPEDFATYYCQQSYSTPLTFGGGTKVEIK

SEQ ID NO: 1192 - protein, 9 aa, Artificial Sequence
  source: /note="Description of Artificial Sequence: Synthetic peptide"
QQSYSTPLT

SEQ ID NO: 1193 - protein, 121 aa, Artificial Sequence
  source: /note="Description of Artificial Sequence: Synthetic polypeptide"
  MOD_RES (45)..(45): Any amino acid
  MOD_RES (61)..(61): Any amino acid
  MOD_RES (72)..(72): Any amino acid
EVQLVESGGGLVKPGGSLRLSCAVSGFTFSNVWMRWVRQAPGKGXEWVGRIKSKTDGGTTXYAAPVKGRFTXSRDDSKNTLYLQMNSLKTEDTAVYYCTSQVWLRGPGDYWGQGTLVTVSS

SEQ ID NO: 1194 - protein, 12 aa, Artificial Sequence
  source: /note="Description of Artificial Sequence: Synthetic peptide"
TSQVWLRGPGDY

SEQ ID NO: 1195 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSLNWVFGGGTKLTVL

SEQ ID NO: 1196 - protein, 10 aa, Artificial Sequence
  source: /note="Description of Artificial Sequence: Synthetic peptide"
QSYDSSLNWV

SEQ ID NO: 1197 - protein, 118 aa, Artificial Sequence
  source: /note="Description of Artificial Sequence: Synthetic polypeptide"
EVQLVESGGGLVKPGGSLRLSCAASGFTFSSYIMNWVRQAPGKGLEWVSSISSSSSYIYYADSVKGRFTISRDNAKNSLYLQMNSLRAEDTAVYYCAREAEWEAFDIWGQGTMVTVSS

SEQ ID NO: 1198 - protein, 11 aa, Artificial Sequence
  source: /note="Description of Artificial Sequence: Synthetic peptide"
AREAEWEAFDI

SEQ ID NO: 1199 - protein, 110 aa, Artificial Sequence
  source: /note="Description of Artificial Sequence: Synthetic polypeptide"
QSVLTQPRSVSGSPGQSVTISCTGTSSDVGGYNYVSWYQQHPGKAPKLMICDVSKRPSGVPDRFSGSKSGNTASLTISGLQAEDEADYYCCSYAGSYTWVFGGGTKLTVL

SEQ ID NO: 1200 - protein, 10 aa, Artificial Sequence
  source: /note="Description of Artificial Sequence: Synthetic peptide"
CSYAGSYTWV

SEQ ID NO: 1201 - protein, 120 aa, Artificial Sequence; identical to SEQ ID NO: 129
  source: /note="Description of Artificial Sequence: Synthetic polypeptide"

SEQ ID NO: 1202 - protein, 13 aa, Artificial Sequence
  source: /note="Description of Artificial Sequence: Synthetic peptide"
ARDVASNYAYFDL

SEQ ID NO: 1203 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVEIK

SEQ ID NO: 1204 - protein, 10 aa, Artificial Sequence
  source: /note="Description of Artificial Sequence: Synthetic peptide"
QQSYSTPPLT

SEQ ID NO: 1205 - protein, 115 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSTSYIYYADSVKGRFTISRDNAKNSLYLQMNSLRAEDTAVYYCARERYGDNWGQGTLVTVSS

SEQ ID NO: 1206 - protein, 8 aa, Artificial Sequence
  source: /note="Description of Artificial Sequence: Synthetic peptide"
ARERYGDN

SEQ ID NO: 1207 - protein, 109 aa, Artificial Sequence
  source: /note="Description of Artificial Sequence: Synthetic polypeptide"
QLVLTQSPSASASLGASVKLTCTLSSGHSSYAIAWHQQQPEKGPRYLMSLNSDGSHSKGDGIPDRFSGSSSGAERYLTISSLQSEDEADYYCQTWGPWVFGGGTKLTVL

SEQ ID NO: 1208 - protein, 7 aa, Artificial Sequence
  source: /note="Description of Artificial Sequence: Synthetic peptide"
QTWGPWV

SEQ ID NO: 1209 - protein, 117 aa, Artificial Sequence
  source: /note="Description of Artificial Sequence: Synthetic polypeptide"
EVQLVESGGGLVKPGGSLRLSCAASGFTFSTYSMNWVRQAPGKGLEWVSSISSSSSYIYYADSVKGRFTISRDNAKNSLYLQMNSLRAEDTAVYYCARVVANWFDPWGQGTLVTVSS

SEQ ID NO: 1210 - protein, 10 aa, Artificial Sequence
  source: /note="Description of Artificial Sequence: Synthetic peptide"
ARVVANWFDP

SEQ ID NO: 1211 - protein, 116 aa, Artificial Sequence
  source: /note="Description of Artificial Sequence: Synthetic polypeptide"
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPQPSWTFGQGTKVEIK

SEQ ID NO: 1212 - protein, 12 aa, Artificial Sequence
  source: /note="Description of Artificial Sequence: Synthetic peptide"
QQYYSTPQPSWT

SEQ ID NO: 1213 - protein, 126 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREAARRYDFWSGLNWFDPWGQGTLVTVSS

SEQ ID NO: 1214 - protein, 19 aa, Artificial Sequence
  source: /note="Description of Artificial Sequence: Synthetic peptide"
AREAARRYDFWSGLNWFDP

SEQ ID NO: 1215 - protein, 113 aa, Artificial Sequence
  source: /note="Description of Artificial Sequence: Synthetic polypeptide"
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTMLTFGGGTKVEIK

SEQ ID NO: 1216 - protein, 9 aa, Artificial Sequence
  source: /note="Description of Artificial Sequence: Synthetic peptide"
QQYYSTMLT

SEQ ID NO: 1217 - protein, 132 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSGGRHYYDSSGYYRLPLDDAFDIWGQGTMVTVSS

SEQ ID NO: 1218 - protein, 25 aa, Artificial Sequence
  source: /note="Description of Artificial Sequence: Synthetic peptide"
AKSGGRHYYDSSGYYRLPLDDAFDI

SEQ ID NO: 1219 - protein, 112 aa, Artificial Sequence
  source: /note="Description of Artificial Sequence: Synthetic polypeptide"
QSVLTQPPSVSGAPGQRVTISCTGSSSSIGAGYDVHWYQQLPGTAPKLLIYGNSNRPSGVPDRFSGSKSGTSASLAITGLQAEDEADYYCQSYDSSLSGSWVFGGGTKLTVL

SEQ ID NO: 1220 - protein, 12 aa, Artificial Sequence
  source: /note="Description of Artificial Sequence: Synthetic peptide"
QSYDSSLSGSWV

SEQ ID NO: 1221 - protein, 119 aa, Artificial Sequence
  source: /note="Description of Artificial Sequence: Synthetic polypeptide"
QVQLVESGGGVVQPGRSLRLSCADSGFTFSTYGMHWVRQAPGKGLEWVALISYDGSNKYYADSVKGRFTISGDNSKNTLYLQMNSLRAEDTAVYYCARAEWLRGAFDIWGQGTMVTVSS

SEQ ID NO: 1222 - protein, 12 aa, Artificial Sequence
  source: /note="Description of Artificial Sequence: Synthetic peptide"
ARAEWLRGAFDI

SEQ ID NO: 1223 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSTNHWVFGGGTKLTVL

SEQ ID NO: 1224 - protein, 10 aa, Artificial Sequence
  source: /note="Description of Artificial Sequence: Synthetic peptide"
QSYDSTNHWV

SEQ ID NO: 1225 - protein, 123 aa, Artificial Sequence
  source: /note="Description of Artificial Sequence: Synthetic polypeptide"
QVQLVESGGGVVQPGRSLRLSCAASGFTFNNYGMHWVRQAPGKGLEWVAVISYDGNNKYYADSVKDRFTISRDNSKNTLYLQMNNLRAEDTAMYYCARAGWELLRIRYYFDFWGQGTLVTVSS

SEQ ID NO: 1226 - protein, 16 aa, Artificial Sequence
  source: /note="Description of Artificial Sequence: Synthetic peptide"
ARAGWELLRIRYYFDF

SEQ ID NO: 1227 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKFLIYGASNLETGVPPRFSGSGSGTDFTFIISSLQPEDIATYYCQQYDNLPPTFGGGTKVEIK

SEQ ID NO: 1228 - protein, 9 aa, Artificial Sequence
  source: /note="Description of Artificial Sequence: Synthetic peptide"
QQYDNLPPT

SEQ ID NO: 1229 - protein, 121 aa, Artificial Sequence
  source: /note="Description of Artificial Sequence: Synthetic polypeptide"
QVQLVESGGGVVQPGRSLRLSCAASGLTFSFYAIHWVRQAPGKGLEWVAYISYEGSDKYYADSVKGRFTISRANSKSTLYLQMNSLRAEDTAVYYCYALFERGNWNDAEYWGQGTLVTVSS

SEQ ID NO: 1230 - protein, 14 aa, Artificial Sequence
  source: /note="Description of Artificial Sequence: Synthetic peptide"
YALFERGNWNDAEY

SEQ ID NO: 1231 - protein, 112 aa, Artificial Sequence
  source: /note="Description of Artificial Sequence: Synthetic polypeptide"
DVVMTQSPLSLPVTLGQPASISCRSSQSLVHSDGNIYLSWYQQRPGQSPRRLIYKVSNRDSGVPDRFSASGSGTDFTLRISRVEAEDVGVYYCMQGTHWPRTFGQGTKLEIK

SEQ ID NO: 1232 - protein, 9 aa, Artificial Sequence
  source: /note="Description of Artificial Sequence: Synthetic peptide"
MQGTHWPRT

SEQ ID NO: 1233 - protein, 122 aa, Artificial Sequence
  source: /note="Description of Artificial Sequence: Synthetic polypeptide"
QVQLVESGGGVVQPGRSLRLSCAASGFTFSGYDIHWVRQAPGKGLEWVAVISYDGSSKFYADSVKGRFTISRDNSKNTLYLQMNSLRAEDTAVYYCAKDLGSSLYYDAFDIWGQGTMVTVSS

SEQ ID NO: 1234 - protein, 15 aa, Artificial Sequence
  source: /note="Description of Artificial Sequence: Synthetic peptide"
AKDLGSSLYYDAFDI

SEQ ID NO: 1235 - protein, 108 aa, Artificial Sequence
  source: /note="Description of Artificial Sequence: Synthetic polypeptide"
DIQMTQSPSSLSASVGDRLTITCRASQSITSYLNWYQQKPGKAPKLLIYAASSLQSGVPSRFSGSGSGTDFTLTISSLQPEDFATYYCQQSYSTPPWTFGQGTKVEIK

SEQ ID NO: 1236 - protein, 10 aa, Artificial Sequence
  source: /note="Description of Artificial Sequence: Synthetic peptide"
QQSYSTPPWT

SEQ ID NO: 1237 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKVDGSYYYYYYGMDVWGQGTTVTVSS

SEQ ID NO: 1238 - protein, 16 aa, Artificial Sequence
  source: /note="Description of Artificial Sequence: Synthetic peptide"
AKVDGSYYYYYYGMDV

SEQ ID NO: 1239 - protein, 111 aa, Artificial Sequence
  source: /note="Description of Artificial Sequence: Synthetic polypeptide"
QSVLTQPASVSGSPGQSITISCTGTSSDVGAYNYVSWYQQHPGKAPKLMIYEVSNRPSGVSNRFSGSKSGNTASLTISGLQAEDEADYYCSSYTSSSTAWVFGGGTKLTVL

SEQ ID NO: 1240 - protein, 11 aa, Artificial Sequence
  source: /note="Description of Artificial Sequence: Synthetic peptide"
SSYTSSSTAWV

SEQ ID NO: 1241 - protein, 130 aa, Artificial Sequence
  source: /note="Description of Artificial Sequence: Synthetic polypeptide"
QVQLVESGGGVVQPGRSLRLSCAASGFTFRTYAMHWVRQAPGKGLEWVAVILSDGNNKYYADSVKGRFTISRDNSKNTLYLQMNSLRAEDTAIFYCAREQEANYYDISGYYHWGESLGYWGQGTLVTVPS

SEQ ID NO: 1242 - protein, 23 aa, Artificial Sequence
  source: /note="Description of Artificial Sequence: Synthetic peptide"
AREQEANYYDISGYYHWGESLGY

SEQ ID NO: 1243 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYGASTLQSGVPSRFSGSGSGTEFTLTISSLQPEDFASYYCQKVNSHPPGLTFGGGTKVEI

SEQ ID NO: 1244 - protein, 11 aa, Artificial Sequence
  source: /note="Description of Artificial Sequence: Synthetic peptide"
QKVNSHPPGLT

SEQ ID NO: 1245 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGRYYDSSGYNGTYEFDYWGQGTLVTVSS

SEQ ID NO: 1246 - protein, 20 aa, Artificial Sequence
  source: /note="Description of Artificial Sequence: Synthetic peptide"
ARGGRYYDSSGYNGTYEFDY

SEQ ID NO: 1247 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPPVTFGPGTKVDIK

SEQ ID NO: 1248 - protein, 10 aa, Artificial Sequence
  source: /note="Description of Artificial Sequence: Synthetic peptide"
QQYNNWPPVT

SEQ ID NO: 1249 - protein, 124 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRKYSSGWSVVNFDYWGQGTLVTVSS

SEQ ID NO: 1250 - protein, 17 aa, Artificial Sequence
  source: /note="Description of Artificial Sequence: Synthetic peptide"
ARDRKYSSGWSVVNFDY

SEQ ID NO: 1251 - protein, 110 aa, Artificial Sequence
  source: /note="Description of Artificial Sequence: Synthetic polypeptide"
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGWVFGGGTKLTVL

SEQ ID NO: 1252 - protein, 11 aa, Artificial Sequence
  source: /note="Description of Artificial Sequence: Synthetic peptide"
AAWDDSLNGWV

SEQ ID NO: 1253 - protein, 123 aa, Artificial Sequence
  source: /note="Description of Artificial Sequence: Synthetic polypeptide"
QVQLVESGGGVVQPGRSLRLSCAASGFMFSSYGMHWVRQAPGKGLEWVAVIWYDGSNKYYADSVKGRFTISRDNSKNTLYLQMNSLRAEDTAVYYCARDGLNWNVPHYGMDVWGQGTTVTVSS

SEQ ID NO: 1254 - protein, 16 aa, Artificial Sequence
  source: /note="Description of Artificial Sequence: Synthetic peptide"
ARDGLNWNVPHYGMDV

SEQ ID NO: 1255 - protein, 108 aa, Artificial Sequence
  source: /note="Description of Artificial Sequence: Synthetic polypeptide"
DIQMTQSPSSVSASVGDRVTITCRASQGISSWLAWYQQKPGKAPKLLIYAASSLQSGVPSRFSGSGSGTDFTLTISSLQPEDFATYYCQQANSFPPLTFGGGTKVEIK

SEQ ID NO: 1256 - protein, 10 aa, Artificial Sequence
  source: /note="Description of Artificial Sequence: Synthetic peptide"
QQANSFPPLT

SEQ ID NO: 1257 - protein, 122 aa, Artificial Sequence; identical to SEQ ID NO: 143
  source: /note="Description of Artificial Sequence: Synthetic polypeptide"

SEQ ID NO: 1258 - protein, 16 aa, Artificial Sequence
  source: /note="Description of Artificial Sequence: Synthetic peptide"
ARVGGAHSGYDGSFDY

SEQ ID NO: 1259 - protein, 110 aa, Artificial Sequence; identical to SEQ ID NO: 144
  source: /note="Description of Artificial Sequence: Synthetic polypeptide"

SEQ ID NO: 1260 - protein, 10 aa, Artificial Sequence
  source: /note="Description of Artificial Sequence: Synthetic peptide"
CSYAGSSTWV

SEQ ID NO: 1261 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDRVIYGMDVWGQGTTVTVSS

SEQ ID NO: 1262 - protein, 11 aa, Artificial Sequence
  source: /note="Description of Artificial Sequence: Synthetic peptide"
ARDRVIYGMDV

SEQ ID NO: 1263 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPQTFGGGTKVEIK

SEQ ID NO: 1264 - protein, 9 aa, Artificial Sequence
  source: /note="Description of Artificial Sequence: Synthetic peptide"
QQYDNLPQT

SEQ ID NO: 1265 - protein, 119 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTFYADSVKGRFTISRDNSKNTLYLQMNSLRAEDTAVYYCARAISESPRYGVYWGQGTLVTVSS

SEQ ID NO: 1266 - protein, 13 aa, Artificial Sequence
  source: /note="Description of Artificial Sequence: Synthetic peptide"
ARAISESPRYGVY

SEQ ID NO: 1267 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGQGTRLEIK

SEQ ID NO: 1268 - protein, 9 aa, Artificial Sequence
  source: /note="Description of Artificial Sequence: Synthetic peptide"
QQYDNLPLT

SEQ ID NO: 1269 - protein, 118 aa, Artificial Sequence
  source: /note="Description of Artificial Sequence: Synthetic polypeptide"
EVQLVETGGGLIQPGGSLRLSCAASEFTVSSNYMSWVRQAPGKGLEWVSLIYSGGSTYYADSVKGRFTISRDNSKNTLYLQMNSLRAEDTAVYYCARVLPFGDYFDYWGQGTLVTVSS

SEQ ID NO: 1270 - protein, 12 aa, Artificial Sequence
  source: /note="Description of Artificial Sequence: Synthetic peptide"
ARVLPFGDYFDY

SEQ ID NO: 1271 - protein, 111 aa, Artificial Sequence
  source: /note="Description of Artificial Sequence: Synthetic polypeptide"
  MOD_RES (110)..(110): Any amino acid
QSVLTQPPSVSGAPGQRVTISCTGSSSNIGAGYDVHWCQQLPGTAPKLLIYGYSNRPSGVPDRFSGSKSGTSASLAITGLQAEDEADYYCQSYDINLSAWVFGGGTRLTXL

SEQ ID NO: 1272 - protein, 11 aa, Artificial Sequence
  source: /note="Description of Artificial Sequence: Synthetic peptide"
QSYDINLSAWV

SEQ ID NO: 1273 - protein, 125 aa, Artificial Sequence
  source: /note="Description of Artificial Sequence: Synthetic polypeptide"
EVQLVESGGGLVQPGGSLRLSCAASGFSVSTKYMTWVRQAPGKGLEWVSALYSGGSDYYADSVKGRFTISRDNSKNTLYLQMSSLRVEDTGVYYCARDSSEVRDHPGHPGRSVGAFDIWGQGTMV

SEQ ID NO: 1274 - protein, 23 aa, Artificial Sequence
  source: /note="Description of Artificial Sequence: Synthetic peptide"
ARDSSEVRDHPGHPGRSVGAFDI

SEQ ID NO: 1275 - protein, 113 aa, Artificial Sequence
  source: /note="Description of Artificial Sequence: Synthetic polypeptide"
  MOD_RES (15)..(15): Any amino acid
DIVMTQSPDSLAVSXGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 1276 - protein, 9 aa, Artificial Sequence
  source: /note="Description of Artificial Sequence: Synthetic peptide"
QQYYSTPLT

SEQ ID NO: 1277 - protein, 118 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDSTPGYGDYISGQGTLVTVSS

SEQ ID NO: 1278 - skipped

SEQ ID NO: 1279 - protein, 107 aa, Artificial Sequence; identical to SEQ ID NO: 555
  source: /note="Description of Artificial Sequence: Synthetic polypeptide"

SEQ ID NO: 1280 - protein, 9 aa, Artificial Sequence
  source: /note="Description of Artificial Sequence: Synthetic peptide"
QQYDNLPIT

SEQ ID NO: 1281 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDYGDFYFDYWGQGTLVTVSS

SEQ ID NO: 1282 - protein, 11 aa, Artificial Sequence
  source: /note="Description of Artificial Sequence: Synthetic peptide"
ARDYGDFYFDY

SEQ ID NO: 1283 - protein, 107 aa, Artificial Sequence; identical to SEQ ID NO: 1103
  source: /note="Description of Artificial Sequence: Synthetic polypeptide"

SEQ ID NO: 1284 - protein, 9 aa, Artificial Sequence
  source: /note="Description of Artificial Sequence: Synthetic peptide"
QQYNNWPRT

SEQ ID NO: 1285 - protein, 123 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCARDLRDQDGYSYGAFDYWGQGTLVTVSS

SEQ ID NO: 1286 - protein, 17 aa, Artificial Sequence
  source: /note="Description of Artificial Sequence: Synthetic peptide"
ARDLRDQDGYSYGAFDY

SEQ ID NO: 1287 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSSWVFGGGTKLTVL

SEQ ID NO: 1288 - protein, 10 aa, Artificial Sequence
  source: /note="Description of Artificial Sequence: Synthetic peptide"
SSYTSSSSWV

SEQ ID NO: 1289 - protein, 119 aa, Artificial Sequence
  source: /note="Description of Artificial Sequence: Synthetic polypeptide"
EVQLVESGGGLVQPGGSLRLSCAASGFTFSSYWMHWVRQAPGKGLVWVSHINGDGSSTSYADSVKGRFTISRDNAKNTLYLQMNSLRAEDTAVYYCASAFWQRGNFDYWGQGTLVTVSS

SEQ ID NO: 1290 - protein, 12 aa, Artificial Sequence
  source: /note="Description of Artificial Sequence: Synthetic peptide"
ASAFWQRGNFDY

SEQ ID NO: 1291 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSILWVFGGGTKLTVL

SEQ ID NO: 1292 - protein, 10 aa, Artificial Sequence
  source: /note="Description of Artificial Sequence: Synthetic peptide"
QSYDSSILWV

SEQ ID NO: 1293 - protein, 127 aa, Artificial Sequence; identical to SEQ ID NO: 137
  source: /note="Description of Artificial Sequence: Synthetic polypeptide"

SEQ ID NO: 1294 - protein, 20 aa, Artificial Sequence
  source: /note="Description of Artificial Sequence: Synthetic peptide"
ARPTAVAAAGNYFYYYGMDV

SEQ ID NO: 1295 - protein, 110 aa, Artificial Sequence
  source: /note="Description of Artificial Sequence: Synthetic polypeptide"
QSVLTQPASVSGSPGQSITISCTGTSSDVGYYNFVSWYQQHPGKAPKLMIYEVSNRPSGVSNRFSGSKSGNTASLIISGLQAEDEADYYCSSYRSSSTLVFGGGTKLTVL

SEQ ID NO: 1296 - protein, 10 aa, Artificial Sequence
  source: /note="Description of Artificial Sequence: Synthetic peptide"
SSYRSSSTLV

SEQ ID NO: 1297 - protein, 127 aa, Artificial Sequence
  source: /note="Description of Artificial Sequence: Synthetic polypeptide"
QLQLQESGSRLVKPSQTLSLTCAVSGGSISSGGYSWSWIRQPPGKGLQWIGYIYHSGSTYYNPSLKSRVTISVDRSKNQFSLKLSSVTAADTAVYYCARFTNPNYYDSSGYYGFDYWGQGTLVTVSS

SEQ ID NO: 1298 - protein, 19 aa, Artificial Sequence
  source: /note="Description of Artificial Sequence: Synthetic peptide"
ARFTNPNYYDSSGYYGFDY

SEQ ID NO: 1299 - protein, 110 aa, Artificial Sequence
  source: /note="Description of Artificial Sequence: Synthetic polypeptide"
QSVLTQPPSASGSPGQSVTISCTGTSSDVGGYNYVSWYQQHPGKAPKLMIYEVSKRPSGVPDRLSGSKSGNTASLTVSGLQAEDEADYYCTSYAGSNNWVFGGGTKLTVL

SEQ ID NO: 1300 - protein, 10 aa, Artificial Sequence
  source: /note="Description of Artificial Sequence: Synthetic peptide"
TSYAGSNNWV

SEQ ID NO: 1301 - protein, 121 aa, Artificial Sequence
  source: /note="Description of Artificial Sequence: Synthetic polypeptide"
QVQLQESGPGLVKPSQTLSLTCAVSGDSIRSGGYYWSWVRQHPGRGLEWIGYIYFSGTTYYNPSLKSRVTISVDTSEKQFSLKLTSVTDADTAVYFCARVKGWLRGYFDYWGQGAPVTVSA

SEQ ID NO: 1302 - protein, 13 aa, Artificial Sequence
  source: /note="Description of Artificial Sequence: Synthetic peptide"
ARVKGWLRGYFDY

SEQ ID NO: 1303 - protein, 110 aa, Artificial Sequence
  source: /note="Description of Artificial Sequence: Synthetic polypeptide"
NFMLTQSHSVSESPGKTVTISCTGSSGNIVNNYVQWYQQRPGSAPIIVIYEDTQRPSGVPDRFSGSIDTSSNSASLTISGLKTEDEADYYCQSYDSGSHVVFGGGTKLTV

SEQ ID NO: 1304 - protein, 10 aa, Artificial Sequence
  source: /note="Description of Artificial Sequence: Synthetic peptide"
QSYDSGSHVV

SEQ ID NO: 1305 - protein, 116 aa, Artificial Sequence
  source: /note="Description of Artificial Sequence: Synthetic polypeptide"
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARVAAFLDYWGQGTLVTVSS

SEQ ID NO: 1306 - protein, 9 aa, Artificial Sequence
  source: /note="Description of Artificial Sequence: Synthetic peptide"
ARVAAFLDY

SEQ ID NO: 1307 - protein, 106 aa, Artificial Sequence
  source: /note="Description of Artificial Sequence: Synthetic polypeptide"
DIQMTQSPSSLSASVGDRVTITCRASQGISNSLAWYQQKPGKAPKLLLYAASRLESGVPSRFSGSGSGTDYTLTISSLQPEDFATYYCQQYYSTRTFGQGTKVEIK

SEQ ID NO: 1308 - protein, 8 aa, Artificial Sequence
  source: /note="Description of Artificial Sequence: Synthetic peptide"
QQYYSTRT

SEQ ID NO: 1309 - protein, 120 aa, Artificial Sequence
  source: /note="Description of Artificial Sequence: Synthetic polypeptide"
QVQLQESGPGLVKPSGTLSLTCAVSGGSISSSNWWSWVRQPPGKGLEWIGEIYHSGTTNYNPSLKSRVTISVDKSKNQFSLKLSSVTAADTAVYYCARTWIQPHNWFDPWGQGTLVTVSS

SEQ ID NO: 1310 - protein, 13 aa, Artificial Sequence
  source: /note="Description of Artificial Sequence: Synthetic peptide"
ARTWIQPHNWFDP

SEQ ID NO: 1311 - protein, 108 aa, Artificial Sequence
  source: /note="Description of Artificial Sequence: Synthetic polypeptide"
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLFTFGPGTKVDIK

SEQ ID NO: 1312 - protein, 10 aa, Artificial Sequence
  source: /note="Description of Artificial Sequence: Synthetic peptide"
QQYNSYPLFT

SEQ ID NO: 1313 - protein, 128 aa, Artificial Sequence
  source: /note="Description of Artificial Sequence: Synthetic polypeptide"
QVQLQESGPGLVKPSETLSLTCTVSGGSISNYYWSWIRQPPGKGLEWIGYIYTSGSTNYNPSLKSRVTISVDTSKNQFSLKLSSVTAADTAVYYCARGPPRLLWFGESPPTYWYFNLWGRGTLVTVSS

SEQ ID NO: 1314 - protein, 22 aa, Artificial Sequence
  source: /note="Description of Artificial Sequence: Synthetic peptide"
ARGPPRLLWFGESPPTYWYFNL

SEQ ID NO: 1315 - protein, 113 aa, Artificial Sequence
  source: /note="Description of Artificial Sequence: Synthetic polypeptide"
  MOD_RES (15)..(15): Any amino acid
DIVMTQSPDSLAVSXGERATINCKSSQSVLYSSNNKNYLAWYQQKPRQPPKLLIYWASTRESGVPDRISGSGSGTDFTLTISSLQAEDVAVYYCQQYYSTPLTFGGGTKVEIK

SEQ ID NO: 1316 - protein, 9 aa, Artificial Sequence
  source: /note="Description of Artificial Sequence: Synthetic peptide"
QQYYSTPLT

SEQ ID NO: 1317 - protein, 134 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYQLAPGSGSYYNWGGYPRESEYYFDYWGQGTLVTVSS

SEQ ID NO: 1318 - protein, 28 aa, Artificial Sequence
  source: /note="Description of Artificial Sequence: Synthetic peptide"
ARYQLAPGSGSYYNWGGYPRESEYYFDY

SEQ ID NO: 1319 - protein, 110 aa, Artificial Sequence
  source: /note="Description of Artificial Sequence: Synthetic polypeptide"
QSVLTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL

SEQ ID NO: 1320 - protein, 10 aa, Artificial Sequence
  source: /note="Description of Artificial Sequence: Synthetic peptide"
CSYAGSYTWV

SEQ ID NO: 1321 - protein, 122 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSRSTNYNPSLKSRVTISVDTSKNQFSLKLSSVTAADTAVYYCARHDTIFGVGQYYFDYWGQGTLVTVSS

SEQ ID NO: 1322 - protein, 16 aa, Artificial Sequence
  source: /note="Description of Artificial Sequence: Synthetic peptide"
ARHDTIFGVGQYYFDY

SEQ ID NO: 1323 - protein, 110 aa, Artificial Sequence
  source: /note="Description of Artificial Sequence: Synthetic polypeptide"
QSVLTQPASVSGSPGQSVTISCTGTSSDVGSYNLVSWYQQHPGKAPKVMIYEDSKRPSGVSNRFSGSKSGNTASLTISGLQAEDEADYYCCSYAGSSTWVFGGGTKLTVL

SEQ ID NO: 1324 - protein, 10 aa, Artificial Sequence
  source: /note="Description of Artificial Sequence: Synthetic peptide"
CSYAGSSTWV

SEQ ID NO: 1325 - protein, 118 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYTSGSTNYNPSLKSRVTISVDTSKNQFSLKLSSVTAADTAVYYCARHSWLRGMADYWGQGTLVTVSS

SEQ ID NO: 1326 - protein, 12 aa, Artificial Sequence
  source: /note="Description of Artificial Sequence: Synthetic peptide"
ARHSWLRGMADY

SEQ ID NO: 1327 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSIWVFGGGTKLTVL

SEQ ID NO: 1328 - protein, 9 aa, Artificial Sequence
  source: /note="Description of Artificial Sequence: Synthetic peptide"
QSYDSSIWV

SEQ ID NO: 1329 - protein, 121 aa, Artificial Sequence
  source: /note="Description of Artificial Sequence: Synthetic polypeptide"
QVQLQESGPGLVKPSETLSLTCTVSGDSMSSYFWTWIRQPPGKGLECIGYFYPSGSTNYNPSLKSRVTISIDTSKNQFSLKLSSVTAADTAVYYCARLKQQLVGFGWFDPWGQGTLVTVSS

SEQ ID NO: 1330 - protein, 15 aa, Artificial Sequence
  source: /note="Description of Artificial Sequence: Synthetic peptide"
ARLKQQLVGFGWFDP

SEQ ID NO: 1331 - protein, 110 aa, Artificial Sequence
  source: /note="Description of Artificial Sequence: Synthetic polypeptide"
QSVLTQPPSVSGAPGQRVTISCTGSSSNIGADYDVHWYQQFPGTAPKVLIYANTNRPSGVPERFSGSKSGTSASLAITGLQAEDEADYYCQSYDHSLNWVFGGGTKLTVL

SEQ ID NO: 1332 - protein, 10 aa, Artificial Sequence
  source: /note="Description of Artificial Sequence: Synthetic peptide"
QSYDHSLNWV

SEQ ID NO: 1333 - protein, 127 aa, Artificial Sequence
  source: /note="Description of Artificial Sequence: Synthetic polypeptide"
QVQLQQSGPGLVKPSQTLSLTCAISGDSVSSNTAAWNWIRQSPSRGLEWLGRTYYRSKWYNDYAVSVISRIIINPDTSKNQFSLQLKSVTPEDTAVYYCARDILRDTSWPHDAFDIWGQGTMVTVSS

SEQ ID NO: 1334 - protein, 17 aa, Artificial Sequence
  source: /note="Description of Artificial Sequence: Synthetic peptide"
ARDILRDTSWPHDAFDI

SEQ ID NO: 1335 - protein, 112 aa, Artificial Sequence
  source: /note="Description of Artificial Sequence: Synthetic polypeptide"
QSVLTQPASVSGSPGQSITISCTGTSSDVGGYNYLSWYQQHPGKAPKLMIYEVSNRPSGVSNRFSGSKSGNTASLTISGLQAEDEADYYCSSYTSSSTPFYVFGTGTKVTVL

SEQ ID NO: 1336 - protein, 12 aa, Artificial Sequence
  source: /note="Description of Artificial Sequence: Synthetic peptide"
SSYTSSSTPFYV

SEQ ID NO: 1337 - protein, 119 aa, Artificial Sequence; identical to SEQ ID NO: 39
  source: /note="Description of Artificial Sequence: Synthetic polypeptide"

SEQ ID NO: 1338 - protein, 12 aa, Artificial Sequence
  source: /note="Description of Artificial Sequence: Synthetic peptide"
ARGVAVDWYFDL

SEQ ID NO: 1339 - protein, 112 aa, Artificial Sequence; identical to SEQ ID NO: 40
  source: /note="Description of Artificial Sequence: Synthetic polypeptide"

SEQ ID NO: 1340 - protein, 12 aa, Artificial Sequence
  source: /note="Description of Artificial Sequence: Synthetic peptide"
QSYDSSLSALYV

SEQ ID NO: 1341 - protein, 119 aa, Artificial Sequence; identical to SEQ ID NO: 39
  source: /note="Description of Artificial Sequence: Synthetic polypeptide"

SEQ ID NO: 1342 - protein, 12 aa, Artificial Sequence
  source: /note="Description of Artificial Sequence: Synthetic peptide"
ARGVAVDWYFDL

SEQ ID NO: 1343 - protein, 112 aa, Artificial Sequence; identical to SEQ ID NO: 40
  source: /note="Description of Artificial Sequence: Synthetic polypeptide"

SEQ ID NO: 1344 - protein, 12 aa, Artificial Sequence
  source: /note="Description of Artificial Sequence: Synthetic peptide"
QSYDSSLSALYV

SEQ ID NO: 1345 - protein, 119 aa, Artificial Sequence; identical to SEQ ID NO: 39
  source: /note="Description of Artificial Sequence: Synthetic polypeptide"

SEQ ID NO: 1346 - protein, 12 aa, Artificial Sequence
  source: /note="Description of Artificial Sequence: Synthetic peptide"
ARGVAVDWYFDL

SEQ ID NO: 1347 - protein, 112 aa, Artificial Sequence; identical to SEQ ID NO: 40
  source: /note="Description of Artificial Sequence: Synthetic polypeptide"

SEQ ID NO: 1348 - protein, 12 aa, Artificial Sequence
  source: /note="Description of Artificial Sequence: Synthetic peptide"
QSYDSSLSALYV

SEQ ID NO: 1349 - protein, 119 aa, Artificial Sequence; identical to SEQ ID NO: 39
  source: /note="Description of Artificial Sequence: Synthetic polypeptide"

SEQ ID NO: 1350 - protein, 12 aa, Artificial Sequence
  source: /note="Description of Artificial Sequence: Synthetic peptide"
ARGVAVDWYFDL

SEQ ID NO: 1351 - protein, 112 aa, Artificial Sequence; identical to SEQ ID NO: 40
  source: /note="Description of Artificial Sequence: Synthetic polypeptide"

SEQ ID NO: 1352 - protein, 12 aa, Artificial Sequence
  source: /note="Description of Artificial Sequence: Synthetic peptide"
QSYDSSLSALYV

SEQ ID NO: 1353 - protein, 119 aa, Artificial Sequence
  source: /note="Description of Artificial Sequence: Synthetic polypeptide"
EVQLVQSGAEVKKPGESLKISCKGSGYSFTSYWTGWVRQMPGKGLEWMGIIYPGDSDTRYRPAFQGQVTISADKSISTAYLQWSSLKASDTAMYYCARGVAVDWYFDLWGRGTLVTVSS

SEQ ID NO: 1354 - protein, 12 aa, Artificial Sequence
  source: /note="Description of Artificial Sequence: Synthetic peptide"
ARGVAVDWYFDL

SEQ ID NO: 1355 - protein, 112 aa, Artificial Sequence; identical to SEQ ID NO: 40
  source: /note="Description of Artificial Sequence: Synthetic polypeptide"

SEQ ID NO: 1356 - protein, 12 aa, Artificial Sequence
  source: /note="Description of Artificial Sequence: Synthetic peptide"
QSYDSSLSALYV

SEQ ID NO: 1357 - protein, 119 aa, Artificial Sequence; identical to SEQ ID NO: 39
  source: /note="Description of Artificial Sequence: Synthetic polypeptide"

SEQ ID NO: 1358 - protein, 12 aa, Artificial Sequence
  source: /note="Description of Artificial Sequence: Synthetic peptide"
ARGVAVDWYFDL

SEQ ID NO: 1359 - protein, 112 aa, Artificial Sequence; identical to SEQ ID NO: 40
  source: /note="Description of Artificial Sequence: Synthetic polypeptide"

SEQ ID NO: 1360 - protein, 12 aa, Artificial Sequence
  source: /note="Description of Artificial Sequence: Synthetic peptide"
QSYDSSLSALYV

SEQ ID NO: 1361 - protein, 119 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISSAYLQWSSLKASDTAMYYCARGVAVDWYFDLWGRGTLVTVSS

SEQ ID NO: 1362 - protein, 12 aa, Artificial Sequence
  source: /note="Description of Artificial Sequence: Synthetic peptide"
ARGVAVDWYFDL

SEQ ID NO: 1363 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVLYVFGTGTKVTVL

SEQ ID NO: 1364 - protein, 12 aa, Artificial Sequence
  source: /note="Description of Artificial Sequence: Synthetic peptide"
QSYDSSLSVLYV

SEQ ID NO: 1365 - protein, 119 aa, Artificial Sequence
  source: /note="Description of Artificial Sequence: Synthetic polypeptide"
EVQLVQSGAEVKKPGESLKISCKGSGYSFTTYWIGWVRQMPGKGLEWMGIIYPADSDTRYSPSFQGQVTISADKSISTAYLQWSSLKASDTAMYYCARGVAVDWYFDLWGRGTLVTVSS

SEQ ID NO: 1366 - protein, 12 aa, Artificial Sequence
  source: /note="Description of Artificial Sequence: Synthetic peptide"
ARGVAVDWYFDL

SEQ ID NO: 1367 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGYTNRPSGVPDRFSGSKSGTSASLAITGLQAEDEADYYCQSYDSSLSALYVFGTGTKVTVL

SEQ ID NO: 1368 - protein, 12 aa, Artificial Sequence
  source: /note="Description of Artificial Sequence: Synthetic peptide"
QSYDSSLSALYV

SEQ ID NO: 1369 - protein, 119 aa, Artificial Sequence; identical to SEQ ID NO: 39
  source: /note="Description of Artificial Sequence: Synthetic polypeptide"

SEQ ID NO: 1370 - protein, 12 aa, Artificial Sequence
  source: /note="Description of Artificial Sequence: Synthetic peptide"
ARGVAVDWYFDL

SEQ ID NO: 1371 - protein, 112 aa, Artificial Sequence
  source: /note="Description of Artificial Sequence: Synthetic polypeptide"
QSVLTQPPSVSGAPGQRVTISCTGSSSNIGAGSDVHWYQQLPGTAPKLLIYGNSNRPSGVPDRFSGSKSGTSASLAITGLQAEDEADYYCQSYDSSLSALYVFGTGTKVTVL

SEQ ID NO: 1372 - protein, 12 aa, Artificial Sequence
  source: /note="Description of Artificial Sequence: Synthetic peptide"
QSYDSSLSALYV

SEQ ID NO: 1373 - protein, 127 aa, Artificial Sequence
  source: /note="Description of Artificial Sequence: Synthetic polypeptide"
QVQLQESGPGLVKPSETLSLTCTVSGASINSYYWTWIRQPPGKGLEWIGYIHDSGNTNYNPALRSRVTISLDTSKNQFSLKVRSVTAADTAVYYCAREVVVQSAKDWSHYYYYMDVWGKGTTVSVSS

SEQ ID NO: 1374 - protein, 21 aa, Artificial Sequence
  source: /note="Description of Artificial Sequence: Synthetic peptide"
AREVVVQSAKDWSHYYYYMDV

SEQ ID NO: 1375 - protein, 107 aa, Artificial Sequence
  source: /note="Description of Artificial Sequence: Synthetic polypeptide"
EIVLTQSPATLSLSPGERASLSCRASQSVGTYLAWYQQKVGQPPRLLIYDASNRATGIPARFSGSGSGTDFTLTISSLDPEDFAVYYCQQRSSWFVTFGQGTRLEIK

SEQ ID NO: 1376 - protein, 9 aa, Artificial Sequence
  source: /note="Description of Artificial Sequence: Synthetic peptide"
QQRSSWFVT

SEQ ID NO: 1377 - protein, 127 aa, Artificial Sequence
  source: /note="Description of Artificial Sequence: Synthetic polypeptide"
QVQLQESGPGLVKPSETLSLTCTVSGGSMTSYYWNWIRHTPGKDLEWIGYIDYSGNTNYNPSLRSRGTISVDTSKNQFSLRVTSVTAADTAVYYCAREVVVSSPKDWSHYYYYMDVWGKGTTVTVSS

SEQ ID NO: 1378 - protein, 21 aa, Artificial Sequence
  source: /note="Description of Artificial Sequence: Synthetic peptide"
AREVVVSSPKDWSHYYYYMDV

SEQ ID NO: 1379 - protein, 107 aa, Artificial Sequence
  source: /note="Description of Artificial Sequence: Synthetic polypeptide"
EIVLTQSPATLSLSPGERATLSCRASQSVSTYLTWYQQKPGQAPRLLIYDASNRATGIPARFSGSGSGTDFTLTITSLEPEDFALYYCQQRSTWFVTFGQGTRLEIK

SEQ ID NO: 1380 - protein, 9 aa, Artificial Sequence
  source: /note="Description of Artificial Sequence: Synthetic peptide"
QQRSTWFVT

SEQ ID NO: 1381 - protein, 127 aa, Artificial Sequence; identical to SEQ ID NO: 1373
  source: /note="Description of Artificial Sequence: Synthetic polypeptide"

SEQ ID NO: 1382 - protein, 21 aa, Artificial Sequence
  source: /note="Description of Artificial Sequence: Synthetic peptide"
AREVVVQSAKDWSHYYYYMDV

SEQ ID NO: 1383 - protein, 107 aa, Artificial Sequence; identical to SEQ ID NO: 1375
  source: /note="Description of Artificial Sequence: Synthetic polypeptide"

SEQ ID NO: 1384 - protein, 9 aa, Artificial Sequence
  source: /note="Description of Artificial Sequence: Synthetic peptide"
QQRSSWFVT

SEQ ID NO: 1385 - protein, 127 aa, Artificial Sequence; identical to SEQ ID NO: 1373
  source: /note="Description of Artificial Sequence: Synthetic polypeptide"

SEQ ID NO: 1386 - protein, 21 aa, Artificial Sequence
  source: /note="Description of Artificial Sequence: Synthetic peptide"
AREVVVQSAKDWSHYYYYMDV

SEQ ID NO: 1387 - protein, 107 aa, Artificial Sequence; identical to SEQ ID NO: 1375
  source: /note="Description of Artificial Sequence: Synthetic polypeptide"

SEQ ID NO: 1388 - protein, 9 aa, Artificial Sequence
  source: /note="Description of Artificial Sequence: Synthetic peptide"
QQRSSWFVT

SEQ ID NO: 1389 - protein, 127 aa, Artificial Sequence; identical to SEQ ID NO: 1373
  source: /note="Description of Artificial Sequence: Synthetic polypeptide"

SEQ ID NO: 1390 - protein, 21 aa, Artificial Sequence
  source: /note="Description of Artificial Sequence: Synthetic peptide"
AREVVVQSAKDWSHYYYYMDV

SEQ ID NO: 1391 - protein, 107 aa, Artificial Sequence; identical to SEQ ID NO: 1375
  source: /note="Description of Artificial Sequence: Synthetic polypeptide"

SEQ ID NO: 1392 - protein, 9 aa, Artificial Sequence
  source: /note="Description of Artificial Sequence: Synthetic peptide"
QQRSSWFVT

SEQ ID NO: 1393 - protein, 127 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSEYSSSWYSRGYYGMDVWGQGTTVTVSS

SEQ ID NO: 1394 - protein, 20 aa, Artificial Sequence
  source: /note="Description of Artificial Sequence: Synthetic peptide"
ARDSEYSSSWYSRGYYGMDV

SEQ ID NO: 1395 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK

SEQ ID NO: 1396 - protein, 9 aa, Artificial Sequence
  source: /note="Description of Artificial Sequence: Synthetic peptide"
MQALQTPPT

SEQ ID NO: 1397 - protein, 127 aa, Artificial Sequence; identical to SEQ ID NO: 1393
  source: /note="Description of Artificial Sequence: Synthetic polypeptide"

SEQ ID NO: 1398 - protein, 20 aa, Artificial Sequence
  source: /note="Description of Artificial Sequence: Synthetic peptide"
ARDSEYSSSWYSRGYYGMDV

SEQ ID NO: 1399 - protein, 112 aa, Artificial Sequence; identical to SEQ ID NO: 1395
  source: /note="Description of Artificial Sequence: Synthetic polypeptide"

SEQ ID NO: 1400 - protein, 9 aa, Artificial Sequence
  source: /note="Description of Artificial Sequence: Synthetic peptide"
MQALQTPPT

SEQ ID NO: 1401 - protein, 127 aa, Artificial Sequence; identical to SEQ ID NO: 1393
  source: /note="Description of Artificial Sequence: Synthetic polypeptide"

SEQ ID NO: 1402 - protein, 20 aa, Artificial Sequence
  source: /note="Description of Artificial Sequence: Synthetic peptide"
ARDSEYSSSWYSRGYYGMDV

SEQ ID NO: 1403 - protein, 112 aa, Artificial Sequence; identical to SEQ ID NO: 1395
  source: /note="Description of Artificial Sequence: Synthetic polypeptide"

SEQ ID NO: 1404 - protein, 9 aa, Artificial Sequence
  source: /note="Description of Artificial Sequence: Synthetic peptide"
MQALQTPPT

SEQ ID NO: 1405 - protein, 121 aa, Artificial Sequence
  source: /note="Description of Artificial Sequence: Synthetic polypeptide"
EVQLVESGGGLVQPGGSLRLSCAASGFIFSSYWMTWVRQAPGKGLEWVASIKYNGNERNYVDSVKGRFTISRDNARNSLFLQLNNLGAEDTAVYYCARQPESTIWYYFDYWGQGTLVTVSS

SEQ ID NO: 1406 - protein, 14 aa, Artificial Sequence
  source: /note="Description of Artificial Sequence: Synthetic peptide"
ARQPESTIWYYFDY

SEQ ID NO: 1407 - protein, 108 aa, Artificial Sequence
  source: /note="Description of Artificial Sequence: Synthetic polypeptide"
SYELTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL

SEQ ID NO: 1408 - protein, 11 aa, Artificial Sequence
  source: /note="Description of Artificial Sequence: Synthetic peptide"
QSADSSGSYVV

SEQ ID NO: 1409 - protein, 121 aa, Artificial Sequence; identical to SEQ ID NO: 1405
  source: /note="Description of Artificial Sequence: Synthetic polypeptide"

SEQ ID NO: 1410 - protein, 14 aa, Artificial Sequence
  source: /note="Description of Artificial Sequence: Synthetic peptide"
ARQPESTIWYYFDY

SEQ ID NO: 1411 - protein, 108 aa, Artificial Sequence
  source: /note="Description of Artificial Sequence: Synthetic polypeptide"
SYVLTQPPSVSVSPGQTARVTCSGHALPDQYTYWYQQRPGRAPVLVIYVNNQRPSGIPDRFSATTSGTTVTLTISGVQAEDEADYYCQSADSSGSYVVFGGGTKLTVL

SEQ ID NO: 1412 - protein, 11 aa, Artificial Sequence
  source: /note="Description of Artificial Sequence: Synthetic peptide"
QSADSSGSYVV

SEQ ID NO: 1413 - protein, 121 aa, Artificial Sequence; identical to SEQ ID NO: 1405
  source: /note="Description of Artificial Sequence: Synthetic polypeptide"

SEQ ID NO: 1414 - protein, 14 aa, Artificial Sequence
  source: /note="Description of Artificial Sequence: Synthetic peptide"
ARQPESTIWYYFDY

SEQ ID NO: 1415 - protein, 108 aa, Artificial Sequence; identical to SEQ ID NO: 1407
  source: /note="Description of Artificial Sequence: Synthetic polypeptide"

SEQ ID NO: 1416 - protein, 11 aa, Artificial Sequence
  source: /note="Description of Artificial Sequence: Synthetic peptide"
QSADSSGSYVV

SEQ ID NO: 1417 - protein, 120 aa, Artificial Sequence; identical to SEQ ID NO: 41
  source: /note="Description of Artificial Sequence: Synthetic polypeptide"

SEQ ID NO: 1418 - protein, 14 aa, Artificial Sequence
  source: /note="Description of Artificial Sequence: Synthetic peptide"
ARRRSFSRPSSIDY

SEQ ID NO: 1419 - protein, 111 aa, Artificial Sequence; identical to SEQ ID NO: 42
  source: /note="Description of Artificial Sequence: Synthetic polypeptide"

SEQ ID NO: 1420 - protein, 8 aa, Artificial Sequence
  source: /note="Description of Artificial Sequence: Synthetic peptide"
MQALQTLT

SEQ ID NO: 1421 - protein, 120 aa, Artificial Sequence; identical to SEQ ID NO: 41
  source: /note="Description of Artificial Sequence: Synthetic polypeptide"

SEQ ID NO: 1422 - protein, 14 aa, Artificial Sequence
  source: /note="Description of Artificial Sequence: Synthetic peptide"
ARRRSFSRPSSIDY

SEQ ID NO: 1423 - protein, 111 aa, Artificial Sequence; identical to SEQ ID NO: 42
  source: /note="Description of Artificial Sequence: Synthetic polypeptide"

SEQ ID NO: 1424 - protein, 8 aa, Artificial Sequence
  source: /note="Description of Artificial Sequence: Synthetic peptide"
MQALQTLT

SEQ ID NO: 1425 - protein, 120 aa, Artificial Sequence; identical to SEQ ID NO: 41
  source: /note="Description of Artificial Sequence: Synthetic polypeptide"

SEQ ID NO: 1426 - protein, 14 aa, Artificial Sequence
  source: /note="Description of Artificial Sequence: Synthetic peptide"
ARRRSFSRPSSIDY

SEQ ID NO: 1427 - protein, 111 aa, Artificial Sequence
  source: /note="Description of Artificial Sequence: Synthetic polypeptide"
  MOD_RES (30)..(30): Any amino acid
DIVMTQSPLSLPVTPGEPASISCRSSQSLXHRNGYNYLDWYLQKPGQSPQLLIYLGSNRASGVPDRFRGSGSGTDFTLKISRVEAEDVGVYYCMQALQTLTFGQGTRLEIK

SEQ ID NO: 1428 - protein, 8 aa, Artificial Sequence
  source: /note="Description of Artificial Sequence: Synthetic peptide"
MQALQTLT

SEQ ID NO: 1429 - protein, 120 aa, Artificial Sequence; identical to SEQ ID NO: 41
  source: /note="Description of Artificial Sequence: Synthetic polypeptide"

SEQ ID NO: 1430 - protein, 14 aa, Artificial Sequence
  source: /note="Description of Artificial Sequence: Synthetic peptide"
ARRRSFSRPSSIDY

SEQ ID NO: 1431 - protein, 111 aa, Artificial Sequence; identical to SEQ ID NO: 1427
  source: /note="Description of Artificial Sequence: Synthetic polypeptide"
  MOD_RES (30)..(30): Any amino acid

SEQ ID NO: 1432 - protein, 8 aa, Artificial Sequence
  source: /note="Description of Artificial Sequence: Synthetic peptide"
MQALQTLT

SEQ ID NO: 1433 - protein, 123 aa, Artificial Sequence
  source: /note="Description of Artificial Sequence: Synthetic polypeptide"
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAANHCSGGSCYDGFDIWGQGTMVTVSS

SEQ ID NO: 1434 - protein, 16 aa, Artificial Sequence
  source: /note="Description of Artificial Sequence: Synthetic peptide"
AANHCSGGSCYDGFDI

SEQ ID NO: 1435 - protein, 108 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQQYGSSPWMFGQGTKVEIK

SEQ ID NO: 1436 - protein, 9 aa, Artificial Sequence
  source: /note="Description of Artificial Sequence: Synthetic peptide"
QQYGSSPWM

SEQ ID NO: 1437 - protein, 123 aa, Artificial Sequence
  source: /note="Description of Artificial Sequence: Synthetic polypeptide"
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPYCSGGSCNDAFDIWGQGTMVTVSS

SEQ ID NO: 1438 - protein, 16 aa, Artificial Sequence
  source: /note="Description of Artificial Sequence: Synthetic peptide"
AAPYCSGGSCNDAFDI

SEQ ID NO: 1439 - protein, 108 aa, Artificial Sequence; identical to SEQ ID NO: 44
  source: /note="Description of Artificial Sequence: Synthetic polypeptide"

SEQ ID NO: 1440 - protein, 9 aa, Artificial Sequence
  source: /note="Description of Artificial Sequence: Synthetic peptide"
QQYGSSPWT

SEQ ID NO: 1441 - protein, 130 aa, Artificial Sequence; identical to SEQ ID NO: 47
  source: /note="Description of Artificial Sequence: Synthetic polypeptide"

SEQ ID NO: 1442 - protein, 21 aa, Artificial Sequence
  source: /note="Description of Artificial Sequence: Synthetic peptide"
TTDPHCSSTSCPIFYYYYMDV

SEQ ID NO: 1443 - protein, 108 aa, Artificial Sequence
  source: /note="Description of Artificial Sequence: Synthetic polypeptide"
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDQGVFGGGTKLTVL

SEQ ID NO: 1444 - protein, 11 aa, Artificial Sequence
  source: /note="Description of Artificial Sequence: Synthetic peptide"
QVWDSSSDQGV

SEQ ID NO: 1445 - protein, 130 aa, Artificial Sequence; identical to SEQ ID NO: 47
  source: /note="Description of Artificial Sequence: Synthetic polypeptide"

SEQ ID NO: 1446 - protein, 21 aa, Artificial Sequence
  source: /note="Description of Artificial Sequence: Synthetic peptide"
TTDPHCSSTSCPIFYYYYMDV

SEQ ID NO: 1447 - protein, 108 aa, Artificial Sequence; identical to SEQ ID NO: 1443
  source: /note="Description of Artificial Sequence: Synthetic polypeptide"

SEQ ID NO: 1448 - protein, 11 aa, Artificial Sequence
  source: /note="Description of Artificial Sequence: Synthetic peptide"
QVWDSSSDQGV

SEQ ID NO: 1449 - protein, 130 aa, Artificial Sequence; identical to SEQ ID NO: 47
  source: /note="Description of Artificial Sequence: Synthetic polypeptide"

SEQ ID NO: 1450 - protein, 21 aa, Artificial Sequence
  source: /note="Description of Artificial Sequence: Synthetic peptide"
TTDPHCSSTSCPIFYYYYMDV

SEQ ID NO: 1451 - protein, 108 aa, Artificial Sequence; identical to SEQ ID NO: 1443
  source: /note="Description of Artificial Sequence: Synthetic polypeptide"

SEQ ID NO: 1452 - protein, 11 aa, Artificial Sequence
  source: /note="Description of Artificial Sequence: Synthetic peptide"
QVWDSSSDQGV

SEQ ID NO: 1453 - protein, 124 aa, Artificial Sequence
  source: /note="Description of Artificial Sequence: Synthetic polypeptide"
QVQLVESGGGVVQPGRSLRLSCAASGFTFNRIAMYWVRQAPGKGLEWVAVISFDGSYEYYAESVKGRFAISRDNSKNTLYLQMNSLRAEDTAVYYCAKSPMGYCTNGVCYPDSWGQGTLVTVSS

SEQ ID NO: 1454 - protein, 17 aa, Artificial Sequence
  source: /note="Description of Artificial Sequence: Synthetic peptide"
AKSPMGYCTNGVCYPDS

SEQ ID NO: 1455 - protein, 111 aa, Artificial Sequence; identical to SEQ ID NO: 46
  source: /note="Description of Artificial Sequence: Synthetic polypeptide"

SEQ ID NO: 1456 - protein, 10 aa, Artificial Sequence
  source: /note="Description of Artificial Sequence: Synthetic peptide"
QSYDINSRWV

SEQ ID NO: 1457 - protein, 124 aa, Artificial Sequence; identical to SEQ ID NO: 1453
  source: /note="Description of Artificial Sequence: Synthetic polypeptide"

SEQ ID NO: 1458 - protein, 17 aa, Artificial Sequence
  source: /note="Description of Artificial Sequence: Synthetic peptide"
AKSPMGYCTNGVCYPDS

SEQ ID NO: 1459 - protein, 111 aa, Artificial Sequence; identical to SEQ ID NO: 46
  source: /note="Description of Artificial Sequence: Synthetic polypeptide"

SEQ ID NO: 1460 - protein, 10 aa, Artificial Sequence
  source: /note="Description of Artificial Sequence: Synthetic peptide"
QSYDINSRWV

SEQ ID NO: 1461 - protein, 124 aa, Artificial Sequence; identical to SEQ ID NO: 1453
  source: /note="Description of Artificial Sequence: Synthetic polypeptide"

SEQ ID NO: 1462 - protein, 17 aa, Artificial Sequence
  source: /note="Description of Artificial Sequence: Synthetic peptide"
AKSPMGYCTNGVCYPDS

SEQ ID NO: 1463 - protein, 111 aa, Artificial Sequence; identical to SEQ ID NO: 46
  source: /note="Description of Artificial Sequence: Synthetic polypeptide"

SEQ ID NO: 1464 - protein, 10 aa, Artificial Sequence
  source: /note="Description of Artificial Sequence: Synthetic peptide"
QSYDINSRWV

SEQ ID NO: 1465 - protein, 127 aa, Artificial Sequence
  source: /note="Description of Artificial Sequence: Synthetic polypeptide"
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAGFGVVITYGSGTDPLFDYWGQGTLVTVSS

SEQ ID NO: 1466 - protein, 21 aa, Artificial Sequence
  source: /note="Description of Artificial Sequence: Synthetic peptide"
ARAGFGVVITYGSGTDPLFDY

SEQ ID NO: 1467 - protein, 112 aa, Artificial Sequence
  source: /note="Description of Artificial Sequence: Synthetic polypeptide"
QSVLTQPPSVSGAPGQRVTISCTGSNSNIGAGYDVHWYQQLPGTAPKLLIYGNSNRPSGVPDRFSGSKSGTSASLAITGLQAEDEADYYCQSYDSSLSGSRVFGGGTKLTVL

SEQ ID NO: 1468 - protein, 12 aa, Artificial Sequence
  source: /note="Description of Artificial Sequence: Synthetic peptide"
QSYDSSLSGSRV

SEQ ID NO: 1469 - protein, 127 aa, Artificial Sequence; identical to SEQ ID NO: 1465
  source: /note="Description of Artificial Sequence: Synthetic polypeptide"

SEQ ID NO: 1470 - protein, 21 aa, Artificial Sequence
  source: /note="Description of Artificial Sequence: Synthetic peptide"
ARAGFGVVITYGSGTDPLFDY

SEQ ID NO: 1471 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSRVFGGGTKLTVL

SEQ ID NO: 1472 - protein, 12 aa, Artificial Sequence
  source: /note="Description of Artificial Sequence: Synthetic peptide"
QSYDSSLSGSRV

SEQ ID NO: 1473 - protein, 130 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCAREYLERYFDGGQRWISYYYMDVWGKGTAVTVSS

SEQ ID NO: 1474 - protein, 23 aa, Artificial Sequence
  source: /note="Description of Artificial Sequence: Synthetic peptide"
AREYLERYFDGGQRWISYYYMDV

SEQ ID NO: 1475 - protein, 111 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTPNSTLVVFGGGTKLTVL

SEQ ID NO: 1476 - protein, 11 aa, Artificial Sequence
  source: /note="Description of Artificial Sequence: Synthetic peptide"
SSYTPNSTLVV

SEQ ID NO: 1477 - protein, 125 aa, Artificial Sequence
  source: /note="Description of Artificial Sequence: Synthetic polypeptide"
QVQLVQSGAEVKKPGASVKVSCKASGYTFSNYYIHWVRQAPGKGLEWMGMINPNGGTTRYPLKFQGRVTMTRDTSTRTVYMELNSLRSEDTALYFCAREIPDILEVVAATGSLDDWGQGSLVTVS

SEQ ID NO: 1478 - protein, 19 aa, Artificial Sequence
  source: /note="Description of Artificial Sequence: Synthetic peptide"
AREIPDILEVVAATGSLDD

SEQ ID NO: 1479 - protein, 109 aa, Artificial Sequence
  source: /note="Description of Artificial Sequence: Synthetic polypeptide"
QSVLTQPPSASGSPGQSVTISCTGTRSDVGGYNYVSWYQQHPGKAPKLIIYEVTKRPSGVPDRFSGSKSGDTASLTVSGLQADDEADYFCSSYAGITNLVFGGGTKLTV

SEQ ID NO: 1480 - protein, 10 aa, Artificial Sequence
  source: /note="Description of Artificial Sequence: Synthetic peptide"
SSYAGITNLV

SEQ ID NO: 1481 - protein, 127 aa, Artificial Sequence; identical to SEQ ID NO: 1393
  source: /note="Description of Artificial Sequence: Synthetic polypeptide"

SEQ ID NO: 1482 - protein, 20 aa, Artificial Sequence
  source: /note="Description of Artificial Sequence: Synthetic peptide"
ARDSEYSSSWYSRGYYGMDV

SEQ ID NO: 1483 - protein, 110 aa, Artificial Sequence
  source: /note="Description of Artificial Sequence: Synthetic polypeptide"
QSVLTQPPSASGSPGQSVTISCTGTSSDVGGYNYVSWYQHHPGKAPKLMIFEVTKRPSGVPDRFSGSKSGNTASLTVSGLQAEDEADYYCYSYGGNNNAVFGGGTKLTVL

SEQ ID NO: 1484 - protein, 10 aa, Artificial Sequence
  source: /note="Description of Artificial Sequence: Synthetic peptide"
YSYGGNNNAV

SEQ ID NO: 1485 - protein, 124 aa, Artificial Sequence
  source: /note="Description of Artificial Sequence: Synthetic polypeptide"
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDSGYSGYGSTYYMDVWGKGTTVTVSS

SEQ ID NO: 1486 - protein, 17 aa, Artificial Sequence
  source: /note="Description of Artificial Sequence: Synthetic peptide"
ARDSGYSGYGSTYYMDV

SEQ ID NO: 1487 - protein, 111 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTVTKVTVL

SEQ ID NO: 1488 - protein, 11 aa, Artificial Sequence
  source: /note="Description of Artificial Sequence: Synthetic peptide"
QSYDSSLSGSV

SEQ ID NO: 1489 - protein, 127 aa, Artificial Sequence; identical to SEQ ID NO: 1393
  source: /note="Description of Artificial Sequence: Synthetic polypeptide"

SEQ ID NO: 1490 - protein, 20 aa, Artificial Sequence
  source: /note="Description of Artificial Sequence: Synthetic peptide"
ARDSEYSSSWYSRGYYGMDV

SEQ ID NO: 1491 - protein, 112 aa, Artificial Sequence; identical to SEQ ID NO: 1395
  source: /note="Description of Artificial Sequence: Synthetic polypeptide"

SEQ ID NO: 1492 - protein, 9 aa, Artificial Sequence
  source: /note="Description of Artificial Sequence: Synthetic peptide"
MQALQTPPT

SEQ ID NO: 1493 - protein, 117 aa, Artificial Sequence
  source: /note="Description of Artificial Sequence: Synthetic polypeptide"
EVQLVQSGPVLVKPGPSVKISCKASGFTFTDYYMHWVKQSHGKSLEWIGLVYPYNGGTSYNQKFKGKATLTVDTSSSTAYMELNSLTSEDSAVYYCARSGPDYFDYWGQGTTLTVSS

SEQ ID NO: 1494 - protein, 10 aa, Artificial Sequence
  source: /note="Description of Artificial Sequence: Synthetic peptide"
ARSGPDYFDY

SEQ ID NO: 1495 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPRTFGGGTKVEIK

SEQ ID NO: 1496 - protein, 9 aa, Artificial Sequence
  source: /note="Description of Artificial Sequence: Synthetic peptide"
QQYNNWPRT

SEQ ID NO: 1497 - protein, 120 aa, Artificial Sequence
  source: /note="Description of Artificial Sequence: Synthetic polypeptide"
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGTTFNHYYYMDVWGKGTTVTVSS

SEQ ID NO: 1498 - protein, 14 aa, Artificial Sequence
  source: /note="Description of Artificial Sequence: Synthetic peptide"
ARGTTFNHYYYMDV

SEQ ID NO: 1499 - protein, 108 aa, Artificial Sequence
  source: /note="Description of Artificial Sequence: Synthetic polypeptide"
  MOD_RES (20)..(20): Any amino acid
DIQMTQSPSSLSASVGDRVXITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 1500 - protein, 10 aa, Artificial Sequence
  source: /note="Description of Artificial Sequence: Synthetic peptide"
QQSYSTPPWT

SEQ ID NO: 1501 - protein, 128 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDVGADSSSAYYYYYMDVWGKGTTVTVSS

SEQ ID NO: 1502 - protein, 19 aa, Artificial Sequence
  source: /note="Description of Artificial Sequence: Synthetic peptide"
TTDVGADSSSAYYYYYMDV

SEQ ID NO: 1503 - protein, 108 aa, Artificial Sequence
  source: /note="Description of Artificial Sequence: Synthetic polypeptide"
  MOD_RES (9)..(9): Any amino acid
EIVLTQSPXSLSLSPGERATLSCGASQSVSSSYLAWYQQKPGLAPRLLIYDASSRATGIPDRFSGSGSGTDFTLTISRLEPEDFAVYYCQQYGSSPYTFGQGTKLEIK

SEQ ID NO: 1504 - protein, 9 aa, Artificial Sequence
  source: /note="Description of Artificial Sequence: Synthetic peptide"
QQYGSSPYT

SEQ ID NO: 1505 - protein, 120 aa, Artificial Sequence; identical to SEQ ID NO: 129
  source: /note="Description of Artificial Sequence: Synthetic polypeptide"

SEQ ID NO: 1506 - protein, 13 aa, Artificial Sequence
  source: /note="Description of Artificial Sequence: Synthetic peptide"
ARDVASNYAYFDL

SEQ ID NO: 1507 - protein, 106 aa, Artificial Sequence
  source: /note="Description of Artificial Sequence: Synthetic polypeptide"
EIVMTQSPATLSLSPGERATLSCRASQSVSSNLAWYHQKPGQAPRLLIYGASTRATGIPARFSGSGSGTEFTLTISSLQSEDFAVYYCQQYDNWPLFGQGTRLEIK

SEQ ID NO: 1508 - protein, 8 aa, Artificial Sequence
  source: /note="Description of Artificial Sequence: Synthetic peptide"
QQYDNWPL

SEQ ID NO: 1509 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSGMSGSGGITYYADSVKGRFTISRDNSKNTLYLQMNSLRAEDTAVYYCAKDTGSMIVELLGYWGQGTLVTVSS

SEQ ID NO: 1510 - protein, 14 aa, Artificial Sequence
  source: /note="Description of Artificial Sequence: Synthetic peptide"
AKDTGSMIVELLGY

SEQ ID NO: 1511 - protein, 109 aa, Artificial Sequence
  source: /note="Description of Artificial Sequence: Synthetic polypeptide"
QSVLTQPPSVSGAPGQRVTISCTGSSSNIGAGSDVHWYQKLPGTAPKVFIYGYNNRPSGVPDRFSGSKSGTSASLAITGLQAEDEADYYCQSYDTSLRVVFGGGTKLTV

SEQ ID NO: 1512 - protein, 10 aa, Artificial Sequence
  source: /note="Description of Artificial Sequence: Synthetic peptide"
QSYDTSLRVV

SEQ ID NO: 1513 - protein, 121 aa, Artificial Sequence; identical to SEQ ID NO: 1509
  source: /note="Description of Artificial Sequence: Synthetic polypeptide"

SEQ ID NO: 1514 - protein, 14 aa, Artificial Sequence
  source: /note="Description of Artificial Sequence: Synthetic peptide"
AKDTGSMIVELLGY

SEQ ID NO: 1515 - protein, 109 aa, Artificial Sequence; identical to SEQ ID NO: 1511
  source: /note="Description of Artificial Sequence: Synthetic polypeptide"

SEQ ID NO: 1516 - protein, 10 aa, Artificial Sequence
  source: /note="Description of Artificial Sequence: Synthetic peptide"
QSYDTSLRVV

SEQ ID NO: 1517 - protein, 126 aa, Artificial Sequence
  source: /note="Description of Artificial Sequence: Synthetic polypeptide"
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRARSVTMVWYRYYMDVWGKGTTVTVSS

SEQ ID NO: 1518 - protein, 17 aa, Artificial Sequence
  source: /note="Description of Artificial Sequence: Synthetic peptide"
TRARSVTMVWYRYYMDV

SEQ ID NO: 1519 - protein, 112 aa, Artificial Sequence
  source: /note="Description of Artificial Sequence: Synthetic polypeptide"
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPYTFGQGTKLEIK

SEQ ID NO: 1520 - protein, 9 aa, Artificial Sequence
  source: /note="Description of Artificial Sequence: Synthetic peptide"
MQSIQLPYT

SEQ ID NO: 1521 - protein, 127 aa, Artificial Sequence
  source: /note="Description of Artificial Sequence: Synthetic polypeptide"
EVQLVESGGGLVQPGGSLRLSCAASGFTFSSYAMHWVRQAPGKGLEYVSVISSNGGSTYYANSVKGRFTISRDNSKNTLYLQMGSLRAEDMAVYYCAREGPFLPSLYSSSRDAFDIWGQGTMVTVSS

SEQ ID NO: 1522 - protein, 20 aa, Artificial Sequence
  source: /note="Description of Artificial Sequence: Synthetic peptide"
AREGPFLPSLYSSSRDAFDI

SEQ ID NO: 1523 - protein, 108 aa, Artificial Sequence
  source: /note="Description of Artificial Sequence: Synthetic polypeptide"
SYVLTQPPSVSVAPGQTARITCGGNNIGSKSVHWYQQKPGQAPVLVVYDDSDRPSGIPERFSGSNSGDTATLTISRVEAGDEADYYCQVWDSSSDPHYVFGTGTKVTV

SEQ ID NO: 1524 - protein, 12 aa, Artificial Sequence
  source: /note="Description of Artificial Sequence: Synthetic peptide"
QVWDSSSDPHYV

SEQ ID NO: 1525 - protein, 121 aa, Artificial Sequence
  source: /note="Description of Artificial Sequence: Synthetic polypeptide"
EVQLVESGGGLVQPGGSLRLSCAASGFTFSSYAMHWVRQAPGKGLEYVSGISSNGGSPYYANSVKGRFTISRDNSKNTLYLQMGSLRAEDMAVYYCARGPIAAAGSYFDYWGQGTLVTVSS

SEQ ID NO: 1526 - protein, 14 aa, Artificial Sequence
  source: /note="Description of Artificial Sequence: Synthetic peptide"
ARGPIAAAGSYFDY

SEQ ID NO: 1527 - protein, 109 aa, Artificial Sequence
  source: /note="Description of Artificial Sequence: Synthetic polypeptide"
SYVLTQPPSVSVAPGQTARITCGGNNIGSKNVHWYQQKPGQAPVLVVYDDSDRPSGIPERFSGSNSGNTATLTISRVEAGDEADYYCQVWDSSSDPHWVFGGGTKLTVL

SEQ ID NO: 1528 - protein, 12 aa, Artificial Sequence
  source: /note="Description of Artificial Sequence: Synthetic peptide"
QVWDSSSDPHWV

SEQ ID NO: 1529 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYHCARDLAVYGMDVWGQGTTVTVSS

SEQ ID NO: 1530 - protein, 11 aa, Artificial Sequence
  source: /note="Description of Artificial Sequence: Synthetic peptide"
ARDLAVYGMDV

SEQ ID NO: 1531 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPVTFGQGTRLEIK

SEQ ID NO: 1532 - protein, 10 aa, Artificial Sequence
  source: /note="Description of Artificial Sequence: Synthetic peptide"
QQLNSYPPVT

SEQ ID NO: 1533 - protein, 118 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDGEGQRETDYWGQGTLVTVSS

SEQ ID NO: 1534 - protein, 12 aa, Artificial Sequence
  source: /note="Description of Artificial Sequence: Synthetic peptide"
ARDGEGQRETDY

SEQ ID NO: 1535 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPRTFGQGTKVEIK

SEQ ID NO: 1536 - protein, 9 aa, Artificial Sequence
  source: /note="Description of Artificial Sequence: Synthetic peptide"
QQYDNLPRT

SEQ ID NO: 1537 - protein, 120 aa, Artificial Sequence; identical to SEQ ID NO: 377
  source: /note="Description of Artificial Sequence: Synthetic polypeptide"

SEQ ID NO: 1538 - protein, 13 aa, Artificial Sequence
  source: /note="Description of Artificial Sequence: Synthetic peptide"
TRDDSSWPHFFDN

SEQ ID NO: 1539 - protein, 108 aa, Artificial Sequence
  source: /note="Description of Artificial Sequence: Synthetic polypeptide"
DIQMTQSPSSLSASVGDRVTITCRASQSIINYLNWYQQKPGKAPKLLIYTASSLQSGVPSRFSGSGSGTDFTLTISSLQPEDFATYFCQQSYSSPLWTFGQGTKVEIK

SEQ ID NO: 1540 - protein, 10 aa, Artificial Sequence
  source: /note="Description of Artificial Sequence: Synthetic peptide"
QQSYSSPLWT

SEQ ID NO: 1541 - protein, 120 aa, Artificial Sequence; identical to SEQ ID NO: 377
  source: /note="Description of Artificial Sequence: Synthetic polypeptide"

SEQ ID NO: 1542 - protein, 13 aa, Artificial Sequence
  source: /note="Description of Artificial Sequence: Synthetic peptide"
TRDDSSWPHFFDN

SEQ ID NO: 1543 - protein, 106 aa, Artificial Sequence
  source: /note="Description of Artificial Sequence: Synthetic polypeptide"
EIVMTQSPATLSVSPGERATLSCRASQSVSSNLAWYHQKPGQAPRLLIYGASTRATGIPARFSGSGSGTEFTLTISSLQSEDFAVYYCQQYDNWPLFGQGTRLEIK

SEQ ID NO: 1544 - protein, 8 aa, Artificial Sequence
  source: /note="Description of Artificial Sequence: Synthetic peptide"
QQYDNWPL

SEQ ID NO: 1545 - protein, 121 aa, Artificial Sequence
  source: /note="Description of Artificial Sequence: Synthetic polypeptide"
QVQLQQWGAGLLKPSETLSRTCGVYGGSFRDYYWSWIRQSPGKGLEWIGEINHSGSTNYNPSLLGRVTISVDTSKNQFSLRLTSVTAADTAVYYCARAYVSSVSEDYFDYWGQGTLVTVSS

SEQ ID NO: 1546 - protein, 15 aa, Artificial Sequence
  source: /note="Description of Artificial Sequence: Synthetic peptide"
ARAYVSSVSEDYFDY

SEQ ID NO: 1547 - protein, 107 aa, Artificial Sequence
  source: /note="Description of Artificial Sequence: Synthetic polypeptide"
DIQMTQSPSSLSASVGDRVTITCRASQSISTYLNWYQQKPGKAPELLIYAASSFQSGVPSRFSGSGSGTDFTLTIRSLEPEDSATYYCQQSYTTPYTFGQGTKLEIK

SEQ ID NO: 1548 - protein, 9 aa, Artificial Sequence
  source: /note="Description of Artificial Sequence: Synthetic peptide"
QQSYTTPYT

SEQ ID NO: 1549 - protein, 122 aa, Artificial Sequence
  source: /note="Description of Artificial Sequence: Synthetic polypeptide"
QVQLQQWGAGLLKPSETLSLTCAVYGGSFSGYYWSWIRQPPGKGLEWIGEVNHSGSTNYNPSLKSRVTISVDTSKNQFFLKLSSVTAADTAVYYCARHWMPRDYYYYGMDVWGQGTTVTVSS

SEQ ID NO: 1550 - protein, 16 aa, Artificial Sequence
  source: /note="Description of Artificial Sequence: Synthetic peptide"
ARHWMPRDYYYYGMDV

SEQ ID NO: 1551 - protein, 107 aa, Artificial Sequence; identical to SEQ ID NO: 503
  source: /note="Description of Artificial Sequence: Synthetic polypeptide"

SEQ ID NO: 1552 - protein, 9 aa, Artificial Sequence
  source: /note="Description of Artificial Sequence: Synthetic peptide"
QQSYSTPRT

SEQ ID NO: 1553 - protein, 120 aa, Artificial Sequence
  source: /note="Description of Artificial Sequence: Synthetic polypeptide"
QVQLQQWGAGLLKPSETLSRTCAVYGGSFTDYYWSWIRQSPGKGLEWIGEINHSGSTNYNPFLKSRVTLSVDTSKNQFSLKLDSLTVADTAIYYCARGAKGDSDWYFDLWGRGTLVTVSS

SEQ ID NO: 1554 - protein, 14 aa, Artificial Sequence
  source: /note="Description of Artificial Sequence: Synthetic peptide"
ARGAKGDSDWYFDL

SEQ ID NO: 1555 - protein, 109 aa, Artificial Sequence
  source: /note="Description of Artificial Sequence: Synthetic polypeptide"
EIVLTQSPATLSLSPGERATLSCRASQSVSNYLAWYQQKPGQAPRLLISDASNRATGVPDRFSGSGSGTDFTLTINSLEPEDFAVYYCQQGDNWPRMYTFGQGTKLQIK

SEQ ID NO: 1556 - protein, 11 aa, Artificial Sequence
  source: /note="Description of Artificial Sequence: Synthetic peptide"
QQGDNWPRMYT

SEQ ID NO: 1557 - protein, 121 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIHYSGSTNYNPSLKSRVTISVDTSKNQFSLKLSSVTAADTAVYYCARHYDILTALSWFDPWGQGTLVTVSS

SEQ ID NO: 1558 - protein, 15 aa, Artificial Sequence
  source: /note="Description of Artificial Sequence: Synthetic peptide"
ARHYDILTALSWFDP

SEQ ID NO: 1559 - protein, 111 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYWVFGGGTKLTVL

SEQ ID NO: 1560 - protein, 12 aa, Artificial Sequence
  source: /note="Description of Artificial Sequence: Synthetic peptide"
GTWDSSLSAYWV

SEQ ID NO: 1561 - protein, 121 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARLLSTEWLFNWFDPWGQGTLVTVSS

SEQ ID NO: 1562 - protein, 15 aa, Artificial Sequence
  source: /note="Description of Artificial Sequence: Synthetic peptide"
ARLLSTEWLFNWFDP

SEQ ID NO: 1563 - protein, 107 aa, Artificial Sequence
  source: /note="Description of Artificial Sequence: Synthetic polypeptide"
SYVLTQPPSVSVSPGQTASITCSGDKLGDKYACWYQQKPGQSPVLVIYQDSKRPSGIPERFSGSNSGNTATLTISGTQAMDEADYYCQAWDSSTAYVFGTGTKVTVL

SEQ ID NO: 1564 - protein, 10 aa, Artificial Sequence
  source: /note="Description of Artificial Sequence: Synthetic peptide"
QAWDSSTAYV

SEQ ID NO: 1565 - protein, 119 aa, Artificial Sequence
  source: /note="Description of Artificial Sequence: Synthetic polypeptide"
EVQLVQSGAEVKKPGESLKISCKGSGYSFTSYWIGWVRQMPGKGLEWVGIIYPGDSDTRYSPSFQGQVTISADKSISTAYLQWSSLKASDTAMYYCARGIAVDWYFDLWGRGTLVTVSS

SEQ ID NO: 1566 - protein, 12 aa, Artificial Sequence
  source: /note="Description of Artificial Sequence: Synthetic peptide"
ARGIAVDWYFDL

SEQ ID NO: 1567 - protein, 111 aa, Artificial Sequence; identical to SEQ ID NO: 639
  source: /note="Description of Artificial Sequence: Synthetic polypeptide"

SEQ ID NO: 1568 - protein, 11 aa, Artificial Sequence
  source: /note="Description of Artificial Sequence: Synthetic peptide"
SSYRGSSTPYV

SEQ ID NO: 1569-1732 - skipped (164 entries)

SEQ ID NO: 1733 - protein, 125 aa, Artificial Sequence
  source: /note="Description of Artificial Sequence: Synthetic polypeptide"
EVQLLESGGGLVQPGGSLRLSCAASGFTFSTYAMSWVRQAPGKGLEWVSTITGSGGFTYYADSVKGRFTISRDNSKNTLFLQMNSLRAEDAAVYYCANHPLASGDEYYYYYMDVWGKGTTVTVSS

SEQ ID NO: 1734 - protein, 18 aa, Artificial Sequence
  source: /note="Description of Artificial Sequence: Synthetic peptide"
ANHPLASGDEYYYYYMDV

SEQ ID NO: 1735 - protein, 109 aa, Artificial Sequence
  source: /note="Description of Artificial Sequence: Synthetic polypeptide"
EIVLTQSPGTLSLSPGERATLSCRASQSVNSRQLAWYQQKPGQGPRLLIYGASSRATGIPDRFSGSGSGTDFTLTISRLEPEDFAVYYCQQYGSSRALTFGGGTKVEIK

SEQ ID NO: 1736 - protein, 10 aa, Artificial Sequence
  source: /note="Description of Artificial Sequence: Synthetic peptide"
QQYGSSRALT

SEQ ID NO: 1737 - protein, 125 aa, Artificial Sequence; identical to SEQ ID NO: 99
  source: /note="Description of Artificial Sequence: Synthetic polypeptide"

SEQ ID NO: 1738 - protein, 18 aa, Artificial Sequence
  source: /note="Description of Artificial Sequence: Synthetic peptide"
ANHPLASGDDYYHYYMDV

SEQ ID NO: 1739 - protein, 109 aa, Artificial Sequence; identical to SEQ ID NO: 100
  source: /note="Description of Artificial Sequence: Synthetic polypeptide"

SEQ ID NO: 1740 - protein, 10 aa, Artificial Sequence
  source: /note="Description of Artificial Sequence: Synthetic peptide"
QQYGSSRALT

SEQ ID NO: 1741 - protein, 128 aa, Artificial Sequence
  source: /note="Description of Artificial Sequence: Synthetic polypeptide"
EVQLLESGGGLVQPGGSLRLSCVASRFTFSNYAMSWVRQAPGKGLEWVSTITGTGDHTYYADSVKGRFTISRDNSKNTLYLQMNSLRAEDTAIFYCANSPCSSASCKSGYYYYYMDVWGKGTTVTVSS

SEQ ID NO: 1742 - protein, 21 aa, Artificial Sequence
  source: /note="Description of Artificial Sequence: Synthetic peptide"
ANSPCSSASCKSGYYYYYMDV

SEQ ID NO: 1743 - protein, 109 aa, Artificial Sequence
  source: /note="Description of Artificial Sequence: Synthetic polypeptide"
EIVLTQSPGTLSLSPGERATLFCRASQSVTSSHLAWYQQKAGQAPRLLIYGASSRATGIPDRFSGSGSGTDFTLTISRLEPEDFAVYYCQQYGSSRSLTFGGGTKVEIK

SEQ ID NO: 1744 - protein, 10 aa, Artificial Sequence
  source: /note="Description of Artificial Sequence: Synthetic peptide"
QQYGSSRSLT

SEQ ID NO: 1745 - protein, 122 aa, Artificial Sequence; identical to SEQ ID NO: 105
  source: /note="Description of Artificial Sequence: Synthetic polypeptide"

SEQ ID NO: 1746 - protein, 15 aa, Artificial Sequence
  source: /note="Description of Artificial Sequence: Synthetic peptide"
ARVNQAVTTPFSMDV

SEQ ID NO: 1747 - protein, 107 aa, Artificial Sequence; identical to SEQ ID NO: 106
  source: /note="Description of Artificial Sequence: Synthetic polypeptide"

SEQ ID NO: 1748 - protein, 9 aa, Artificial Sequence
  source: /note="Description of Artificial Sequence: Synthetic peptide"
QQYNNWPIT

SEQ ID NO: 1749 - protein, 122 aa, Artificial Sequence
  source: /note="Description of Artificial Sequence: Synthetic polypeptide"
QVQLVQSGAEVKKPGSSVKVSCKASGDTFSSSALSWVRQAPGQGLEWMGRIIPILGITNYAQKFQGRVTITADKSTSTAYMELNSLRSEDTAVYYCARANQPVTTPFSMDVWGQGTTVTVSS

SEQ ID NO: 1750 - protein, 15 aa, Artificial Sequence
  source: /note="Description of Artificial Sequence: Synthetic peptide"
ARANQPVTTPFSMDV

SEQ ID NO: 1751 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYAASTRATGIPARFSGSGSGTEFTLTISSLQSEDFAVYYCQQYNNWPITFGQGTRLEIK

SEQ ID NO: 1752 - protein, 9 aa, Artificial Sequence
  source: /note="Description of Artificial Sequence: Synthetic peptide"
QQYNNWPIT

SEQ ID NO: 1753 - protein, 123 aa, Artificial Sequence; identical to SEQ ID NO: 109
  source: /note="Description of Artificial Sequence: Synthetic polypeptide"

SEQ ID NO: 1754 - protein, 16 aa, Artificial Sequence
  source: /note="Description of Artificial Sequence: Synthetic peptide"
ARDSDVDTSMVTWFDY

SEQ ID NO: 1755 - protein, 108 aa, Artificial Sequence; identical to SEQ ID NO: 110
  source: /note="Description of Artificial Sequence: Synthetic polypeptide"

SEQ ID NO: 1756 - protein, 10 aa, Artificial Sequence
  source: /note="Description of Artificial Sequence: Synthetic peptide"
QQSYSTPPWT

SEQ ID NO: 1757 - protein, 123 aa, Artificial Sequence
  source: /note="Description of Artificial Sequence: Synthetic polypeptide"
QVQLVESGGGVVQPGRSLRLSCAASGFTFSTYAMHWVRQAPGKGLEWVAVISYDGTNKFYADSVKGRFTISRDNSKNTLYLQMNSLRAEDTAVFYCARDSDVDTAMVTWFDYWGQGTLVTVSS

SEQ ID NO: 1758 - protein, 16 aa, Artificial Sequence
  source: /note="Description of Artificial Sequence: Synthetic peptide"
ARDSDVDTAMVTWFDY

SEQ ID NO: 1759 - protein, 108 aa, Artificial Sequence
  source: /note="Description of Artificial Sequence: Synthetic polypeptide"
DIQMTQSPSSLSASVGDRVTITCRASQSISSYLNWYQHKPGKAPKLLIYASSSLQSGVPSRFSGSGSGTDFTLTISSLQPEDFATYYCQQSYSTPPWTFGQGTKVEIK

SEQ ID NO: 1760 - protein, 10 aa, Artificial Sequence
  source: /note="Description of Artificial Sequence: Synthetic peptide"
QQSYSTPPWT

SEQ ID NO: 1761 - protein, 117 aa, Artificial Sequence
  source: /note="Description of Artificial Sequence: Synthetic polypeptide"
EVQLVESGGGLVQPGGSLRLSCAASGITVSSNYMSWVRQAPGKGLEWVSVIYSGGSTYYADSVKGRVTISRDNSKNTLYLQMNSLRVEDTAVYYCARDLGDYGMDVWGQGTTVTVSS

SEQ ID NO: 1762 - protein, 11 aa, Artificial Sequence
  source: /note="Description of Artificial Sequence: Synthetic peptide"
ARDLGDYGMDV

SEQ ID NO: 1763 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK

SEQ ID NO: 1764 - protein, 10 aa, Artificial Sequence
  source: /note="Description of Artificial Sequence: Synthetic peptide"
QQLNSYPPYT

SEQ ID NO: 1765 - protein, 117 aa, Artificial Sequence; identical to SEQ ID NO: 119
  source: /note="Description of Artificial Sequence: Synthetic polypeptide"

SEQ ID NO: 1766 - protein, 11 aa, Artificial Sequence
  source: /note="Description of Artificial Sequence: Synthetic peptide"
ARDLYYYGMDV

SEQ ID NO: 1767 - protein, 107 aa, Artificial Sequence; identical to SEQ ID NO: 120
  source: /note="Description of Artificial Sequence: Synthetic polypeptide"

SEQ ID NO: 1768 - protein, 9 aa, Artificial Sequence
  source: /note="Description of Artificial Sequence: Synthetic peptide"
QQLNSYSYT

SEQ ID NO: 1769 - protein, 120 aa, Artificial Sequence; identical to SEQ ID NO: 103
  source: /note="Description of Artificial Sequence: Synthetic polypeptide"

SEQ ID NO: 1770 - protein, 13 aa, Artificial Sequence
  source: /note="Description of Artificial Sequence: Synthetic peptide"
ARSRPTPDWYFDL

SEQ ID NO: 1771 - protein, 110 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPGVVFGGGTKLTVL

SEQ ID NO: 1772 - protein, 13 aa, Artificial Sequence
  source: /note="Description of Artificial Sequence: Synthetic peptide"
QVWDSSSDHPGVV

SEQ ID NO: 1773 - protein, 120 aa, Artificial Sequence
  source: /note="Description of Artificial Sequence: Synthetic polypeptide"
QVQLVQSGAEVKKPGASVKVSCKASGYTFTSHYIHWVRQAPGQGLEWMGIINPSGGSTSYAQKFQGRVTMTRDTSTTTLYMDLSSLRSEDTAVYYCAKSRPTPDWYFDLWGRGTLVTVSS

SEQ ID NO: 1774 - protein, 13 aa, Artificial Sequence
  source: /note="Description of Artificial Sequence: Synthetic peptide"
AKSRPTPDWYFDL

SEQ ID NO: 1775 - protein, 110 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDNDRPSGIPERFSGSNSGNTATLTISRVEAGDEADYYCQVWDGGSDHPGVVFGGGTKLTVL

SEQ ID NO: 1776 - protein, 13 aa, Artificial Sequence
  source: /note="Description of Artificial Sequence: Synthetic peptide"
QVWDGGSDHPGVV

SEQ ID NO: 1777 - protein, 123 aa, Artificial Sequence; identical to SEQ ID NO: 111
  source: /note="Description of Artificial Sequence: Synthetic polypeptide"

SEQ ID NO: 1778 - protein, 16 aa, Artificial Sequence
  source: /note="Description of Artificial Sequence: Synthetic peptide"
AKDPLITGPTYQYFHY

SEQ ID NO: 1779 - protein, 110 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEAEYHCQVWDSSSDRPGVVFGGGTKLTVL

SEQ ID NO: 1780 - protein, 13 aa, Artificial Sequence
  source: /note="Description of Artificial Sequence: Synthetic peptide"
QVWDSSSDRPGVV

SEQ ID NO: 1781 - protein, 123 aa, Artificial Sequence; identical to SEQ ID NO: 111
  source: /note="Description of Artificial Sequence: Synthetic polypeptide"

SEQ ID NO: 1782 - protein, 16 aa, Artificial Sequence
  source: /note="Description of Artificial Sequence: Synthetic peptide"
AKDPLITGPTYQYFHY

SEQ ID NO: 1783 - protein, 110 aa, Artificial Sequence; identical to SEQ ID NO: 1779
  source: /note="Description of Artificial Sequence: Synthetic polypeptide"

SEQ ID NO: 1784 - protein, 13 aa, Artificial Sequence
  source: /note="Description of Artificial Sequence: Synthetic peptide"
QVWDSSSDRPGVV

SEQ ID NO: 1785 - protein, 120 aa, Artificial Sequence
  source: /note="Description of Artificial Sequence: Synthetic polypeptide"
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARALQGPWLGADYWGQGTLVTVSS

SEQ ID NO: 1786 - protein, 13 aa, Artificial Sequence
  source: /note="Description of Artificial Sequence: Synthetic peptide"
ARALQGPWLGADY

SEQ ID NO: 1787 - protein, 110 aa, Artificial Sequence
  source: /note="Description of Artificial Sequence: Synthetic polypeptide"
  MOD_RES (11)..(11): Any amino acid
  MOD_RES (67)..(67): Any amino acid
  MOD_RES (79)..(79): Any amino acid
  MOD_RES (89)..(89): Any amino acid
NFMLNQPPCEXESPGKTVTISCTGSSGSIASNYDQWYQQRPGSAPTTVIYEDKQRTSGVLDWFSGSXARSSNSPSLTIXGRKREDEADXYCQSYDSSKGVFGGGTKLTVL

SEQ ID NO: 1788 - protein, 9 aa, Artificial Sequence
  source: /note="Description of Artificial Sequence: Synthetic peptide"
QSYDSSKGV

SEQ ID NO: 1789 - protein, 119 aa, Artificial Sequence; identical to SEQ ID NO: 115
  source: /note="Description of Artificial Sequence: Synthetic polypeptide"

SEQ ID NO: 1790 - protein, 12 aa, Artificial Sequence
  source: /note="Description of Artificial Sequence: Synthetic peptide"
AGGTWLRSSFDY

SEQ ID NO: 1791 - protein, 110 aa, Artificial Sequence; identical to SEQ ID NO: 116
  source: /note="Description of Artificial Sequence: Synthetic polypeptide"

SEQ ID NO: 1792 - protein, 9 aa, Artificial Sequence
  source: /note="Description of Artificial Sequence: Synthetic peptide"
QSYDSSNWV

SEQ ID NO: 1793 - protein, 122 aa, Artificial Sequence; identical to SEQ ID NO: 107
  source: /note="Description of Artificial Sequence: Synthetic polypeptide"

SEQ ID NO: 1794 - protein, 15 aa, Artificial Sequence
  source: /note="Description of Artificial Sequence: Synthetic peptide"
ARGGDTAMGPEYFDY

SEQ ID NO: 1795 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVL

SEQ ID NO: 1796 - protein, 10 aa, Artificial Sequence
  source: /note="Description of Artificial Sequence: Synthetic peptide"
SSYTSSSTLL

SEQ ID NO: 1797 - protein, 122 aa, Artificial Sequence
  source: /note="Description of Artificial Sequence: Synthetic polypeptide"
QVQLQESGPGLVKPSGTLSLTCAVSGGSISSNNWWSWVRQPPGKGLEWIGEIYHSGSTNYNPSLKSRVTISVDKSKNQFSLKLSSVTAADTAVYYCAKGGDRAMGPEYFDYWGQGTLVTVSS

SEQ ID NO: 1798 - protein, 15 aa, Artificial Sequence
  source: /note="Description of Artificial Sequence: Synthetic peptide"
AKGGDRAMGPEYFDY

SEQ ID NO: 1799 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSFTSSSTLLFGGGTRLTVL

SEQ ID NO: 1800 - protein, 10 aa, Artificial Sequence
  source: /note="Description of Artificial Sequence: Synthetic peptide"
SSFTSSSTLL

SEQ ID NO: 1801 - protein, 120 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTKYAQKLQGRVTMTTDTSTSTAYMELRSLRSDDTAVYFCARVLGIIVAGSLNWGQGTLVTVSS

SEQ ID NO: 1802 - protein, 13 aa, Artificial Sequence
  source: /note="Description of Artificial Sequence: Synthetic peptide"
ARVLGIIVAGSLN

SEQ ID NO: 1803 - protein, 110 aa, Artificial Sequence
  source: /note="Description of Artificial Sequence: Synthetic polypeptide"
NFVLTQPHSVSESPGKTVTISCTGSSGSIASNYVQWYQQRPGSAPTTVIYEDNQRPSGVPDRFSGSIDSSSNSASLTISGLKTEDEADYYCQSYDSSTWVFGGGTKLTVL

SEQ ID NO: 1804 - protein, 9 aa, Artificial Sequence
  source: /note="Description of Artificial Sequence: Synthetic peptide"
QSYDSSTWV

SEQ ID NO: 1805 - protein, 121 aa, Artificial Sequence
  source: /note="Description of Artificial Sequence: Synthetic polypeptide"
QVQLVQSGAEVKKPGASVKVSCKASGYTFSSNYMHWVRQAPGQGLEWMGIINPSGGSTTYAQKFQGRVTMTRDTSTSTVYMELSSLRSEDTAVYYCARDLGYIPASDAFDIWGQGTMVTVS

SEQ ID NO: 1806 - protein, 15 aa, Artificial Sequence
  source: /note="Description of Artificial Sequence: Synthetic peptide"
ARDLGYIPASDAFDI

SEQ ID NO: 1807 - protein, 111 aa, Artificial Sequence
  source: /note="Description of Artificial Sequence: Synthetic polypeptide"
QSVLTQPRSVSGSPGQSVTISCTGTSSDFGGYNYVSWYQQHPGKAPKLMIYDVSKRPSGVPDRFSGSKSGNTASLTISGLQAEDEADYYCCSYAGSYTRYVFGTGTKVTVL

SEQ ID NO: 1808 - protein, 11 aa, Artificial Sequence
  source: /note="Description of Artificial Sequence: Synthetic peptide"
CSYAGSYTRYV

SEQ ID NO: 1809 - protein, 122 aa, Artificial Sequence
  source: /note="Description of Artificial Sequence: Synthetic polypeptide"
QVQLVQSGAEVKKPGSSVKVSCKASGGTFSSYTISWVRQAPGHGLEWMGRIIPILGIANYAQKFQGRVTITADKSTSTAYMELSSLRSEDTAVYYCARFSNYCTSTSCYDYWGQGTLVTVSS

SEQ ID NO: 1810 - protein, 15 aa, Artificial Sequence
  source: /note="Description of Artificial Sequence: Synthetic peptide"
ARFSNYCTSTSCYDY

SEQ ID NO: 1811 - protein, 111 aa, Artificial Sequence
  source: /note="Description of Artificial Sequence: Synthetic polypeptide"
QSVLTQPPSVSGAPGQRVTISCTGSNSNIGAGYDVHWYQQLPGTAPKLLIYVNSNRPSGVPDRFSGSKSGTSASLAITGLQAEDEADYSCQSYDSSLSGSVFGTGTKVTVL

SEQ ID NO: 1812 - protein, 11 aa, Artificial Sequence
  source: /note="Description of Artificial Sequence: Synthetic peptide"
QSYDSSLSGSV

SEQ ID NO: 1813 - protein, 122 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDGITGTIEYYFDYWGQGTLVTVSS

SEQ ID NO: 1814 - protein, 15 aa, Artificial Sequence
  source: /note="Description of Artificial Sequence: Synthetic peptide"
ARDGITGTIEYYFDY

SEQ ID NO: 1815 - protein, 109 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPPGVTFGQGTRLEIK

SEQ ID NO: 1816 - protein, 11 aa, Artificial Sequence
  source: /note="Description of Artificial Sequence: Synthetic peptide"
QQRSNWPPGVT

SEQ ID NO: 1817 - protein, 122 aa, Artificial Sequence
  source: /note="Description of Artificial Sequence: Synthetic polypeptide"
QVQLVQSGAEVKKPGASVKVSCKVSGYTLTELSMHWVRQAPGKGLEWMGGFDPEDGETIYVQKFQGRATMTEHTSTETAYMELSSLRSEDTAVYYCATNAEIAARKGGMDVWGQGTTVTVSS

SEQ ID NO: 1818 - protein, 15 aa, Artificial Sequence
  source: /note="Description of Artificial Sequence: Synthetic peptide"
ATNAEIAARKGGMDV

SEQ ID NO: 1819 - protein, 112 aa, Artificial Sequence
  source: /note="Description of Artificial Sequence: Synthetic polypeptide"
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPWTFGQGTKVEIK

SEQ ID NO: 1820 - protein, 9 aa, Artificial Sequence
  source: /note="Description of Artificial Sequence: Synthetic peptide"
MQALQTPWT

SEQ ID NO: 1821 - protein, 122 aa, Artificial Sequence
  source: /note="Description of Artificial Sequence: Synthetic polypeptide"
QVQLVQSGAEVKKPGASVKVSCKASGYTFTSYYIHWVRQAPGQGLEWMGIINPSAGSTSYAQKFQGRVTMTRDTSTSTVYMELSSLRSEDTAVYYCARDIALVPAAMGLDYWGQGTLVTVSS

SEQ ID NO: 1822 - protein, 15 aa, Artificial Sequence
  source: /note="Description of Artificial Sequence: Synthetic peptide"
ARDIALVPAAMGLDY

SEQ ID NO: 1823 - protein, 107 aa, Artificial Sequence
  source: /note="Description of Artificial Sequence: Synthetic polypeptide"
DIQMTQSPSSLSASVGDRVTITCRASQSSSRYLNWYQQKPGKAPKLLIYAASSLQSGVPSRFSGSGSGTDFTLTISSLQPEDFATYYCQQSYRTRLTFGGGTKVEIK

SEQ ID NO: 1824 - protein, 9 aa, Artificial Sequence
  source: /note="Description of Artificial Sequence: Synthetic peptide"
QQSYRTRLT

SEQ ID NO: 1825 - protein, 123 aa, Artificial Sequence
  source: /note="Description of Artificial Sequence: Synthetic polypeptide"
QMQLVQSGPEVKKPGTSVKVSCKASGFTFTNSAVQWVRQSRRQRLEWIGWIVVGSGNTNYAQKFQERVTITRDMSTSTAYMELSSLRSEDTAVYYCAAVDCNSTSCYDAFDIWGQGTMVTVSS

SEQ ID NO: 1826 - protein, 16 aa, Artificial Sequence
  source: /note="Description of Artificial Sequence: Synthetic peptide"
AAVDCNSTSCYDAFDI

SEQ ID NO: 1827 - protein, 108 aa, Artificial Sequence
  source: /note="Description of Artificial Sequence: Synthetic polypeptide"
EIVLTQSPGTLSLSPGERATLSCRASQSFRSSYLAWYQQKPGQAPRLLIYGASSRATGIPDRFSGSGSGSDFTLTISRLEPEDFAVYYCQQYDISPWTFGQGTKVEIK

SEQ ID NO: 1828 - protein, 9 aa, Artificial Sequence
  source: /note="Description of Artificial Sequence: Synthetic peptide"
QQYDISPWT

SEQ ID NO: 1829 - protein, 126 aa, Artificial Sequence
  source: /note="Description of Artificial Sequence: Synthetic polypeptide"
QVQLVQSGAEVKKPGSSVKVSCKASGGTVNNYAINWVRQAPGQGLEWMGGIVPIFGTPNYAQKFQGRVTITADESTSTAYMELSSLRSEDTAVYYCAKVSLTLPIAAAPRFWFDSWGQGTLVTVSS

SEQ ID NO: 1830 - protein, 19 aa, Artificial Sequence
  source: /note="Description of Artificial Sequence: Synthetic peptide"
AKVSLTLPIAAAPRFWFDS

SEQ ID NO: 1831 - protein, 109 aa, Artificial Sequence
  source: /note="Description of Artificial Sequence: Synthetic polypeptide"
EIVMTQSPATLSVSPGERATLSCRASQSVSSHLAWYQQKPGQAPRLLIYGASTRATGIPARFSGSGSGTEFTLTISSLQSEDFAVYYCQQYHNWPPALTFGGGTKVEIK

SEQ ID NO: 1832 - protein, 11 aa, Artificial Sequence
  source: /note="Description of Artificial Sequence: Synthetic peptide"
QQYHNWPPALT

SEQ ID NO: 1833 - protein, 121 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGRIIPMLVIATYARKFQGRVTITADKSTSTAYMELSSLRSEDTAVYYCARGVVAATPGNFDIWGQGTMVTVSS

SEQ ID NO: 1834 - protein, 14 aa, Artificial Sequence
  source: /note="Description of Artificial Sequence: Synthetic peptide"
ARGVVAATPGNFDI

SEQ ID NO: 1835 - protein, 106 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNGLTFGGGTKVEIK

SEQ ID NO: 1836 - protein, 8 aa, Artificial Sequence
  source: /note="Description of Artificial Sequence: Synthetic peptide"
QQYNNGLT

SEQ ID NO: 1837 - protein, 122 aa, Artificial Sequence; identical to SEQ ID NO: 161
  source: /note="Description of Artificial Sequence: Synthetic polypeptide"

SEQ ID NO: 1838 - protein, 15 aa, Artificial Sequence
  source: /note="Description of Artificial Sequence: Synthetic peptide"
ARDLLDPQLDDAFDI

SEQ ID NO: 1839 - protein, 108 aa, Artificial Sequence; identical to SEQ ID NO: 162
  source: /note="Description of Artificial Sequence: Synthetic polypeptide"

SEQ ID NO: 1840 - protein, 9 aa, Artificial Sequence
  source: /note="Description of Artificial Sequence: Synthetic peptide"
QQYGSSPWT

SEQ ID NO: 1841 - protein, 122 aa, Artificial Sequence
  source: /note="Description of Artificial Sequence: Synthetic polypeptide"
QVQLVQSGAEVKKPGSSVKVSCKASGGTFSSYAINWVRQAPGQGLEWMGRIIPILDISNYAQKFQGRVTITADKSTSIAYMELSSLRSEDTAVYYCARGGYSYGQLYYFDYWGQGTLVTVSS

SEQ ID NO: 1842 - protein, 15 aa, Artificial Sequence
  source: /note="Description of Artificial Sequence: Synthetic peptide"
ARGGYSYGQLYYFDY

SEQ ID NO: 1843 - protein, 107 aa, Artificial Sequence
  source: /note="Description of Artificial Sequence: Synthetic polypeptide"
EIVLTQSPGTLSLPPGERATLSCRASQSVSSSYLAWYQQKPGQAPRLLIYGASSRATGIPDRFSGSGSGTDFTLTISRLEPEDFAVYYCQQYANSRTFGQGTKVEIK

SEQ ID NO: 1844 - protein, 8 aa, Artificial Sequence
  source: /note="Description of Artificial Sequence: Synthetic peptide"
QQYANSRT

SEQ ID NO: 1845 - protein, 123 aa, Artificial Sequence
  source: /note="Description of Artificial Sequence: Synthetic polypeptide"
QVQLVESGGGLVKPGGSLRLSCAASGFTFSHYNMIWIRQAPGKGLEWVSYISSSSSYTNCSDSVRGRFTISRDNAKNSLYLQMNSLRAEDTAVYYCARDRGYSGYGLDRFDYWGQGTLVTVSS

SEQ ID NO: 1846 - protein, 16 aa, Artificial Sequence
  source: /note="Description of Artificial Sequence: Synthetic peptide"
ARDRGYSGYGLDRFDY

SEQ ID NO: 1847 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASHLETGVPSRFSGSGSGTDFTFTISSLQPEDIATYYCQQYDNLPLTFGGGTKVEIK

SEQ ID NO: 1848 - protein, 9 aa, Artificial Sequence
  source: /note="Description of Artificial Sequence: Synthetic peptide"
QQYDNLPLT

SEQ ID NO: 1849 - protein, 133 aa, Artificial Sequence
  source: /note="Description of Artificial Sequence: Synthetic polypeptide"
QVQLVESGGGLVKPGGSLRLSCAASGFTFSDYYMTWIRQAPGKGLEWVSYITTSSSYTNYADSVKGRFTISRDNAKNSLYLQMNSLRAEDTAVYYCARDNITMVRGVIVRPNDGGYYYALDVWGQGTTVTVSS

SEQ ID NO: 1850 - protein, 26 aa, Artificial Sequence
  source: /note="Description of Artificial Sequence: Synthetic peptide"
ARDNITMVRGVIVRPNDGGYYYALDV

SEQ ID NO: 1851 - protein, 108 aa, Artificial Sequence
  source: /note="Description of Artificial Sequence: Synthetic polypeptide"
DIQMTQSPSSLSASVGDRVTITCRASQSISSYLNWYQEKPGKAPKLLIYAASSLQSGVPSRFSGSGSGTDFTLTISSLQPEDFATYYCQQSYSTRALTFGGGTKVEIK

SEQ ID NO: 1852 - protein, 10 aa, Artificial Sequence
  source: /note="Description of Artificial Sequence: Synthetic peptide"
QQSYSTRALT

SEQ ID NO: 1853 - protein, 129 aa, Artificial Sequence
  source: /note="Description of Artificial Sequence: Synthetic polypeptide"
EVQLLESGGGLVQPGGSLRLSCTASGFTFSTYAMSWVRQAPGKGLEWVSAISDSGGSTYYADSVKGRFTISRDNSKNTLYLQMNSLRAEDTAVYYCAKSKTVERLPYCGGDCFSAIDYWGQGTLVTVSS

SEQ ID NO: 1854 - protein, 22 aa, Artificial Sequence
  source: /note="Description of Artificial Sequence: Synthetic peptide"
AKSKTVERLPYCGGDCFSAIDY

SEQ ID NO: 1855 - protein, 108 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPPFTFGPGTKVHIK

SEQ ID NO: 1856 - protein, 10 aa, Artificial Sequence
  source: /note="Description of Artificial Sequence: Synthetic peptide"
QQYDNLPPFT

SEQ ID NO: 1857 - protein, 125 aa, Artificial Sequence
  source: /note="Description of Artificial Sequence: Synthetic polypeptide"
EVQLLESGGGLVQPGGSLRLSCAASGFTFSSYAMSWVRQAPGKGLEWISAISGSGGRTYNADSVKGRFTISRDNSKNTLYLQMNSLRAEDTAVYYCAKAGPAAAYGWYYYYMDVWGKGTTVTASS

SEQ ID NO: 1858 - protein, 18 aa, Artificial Sequence
  source: /note="Description of Artificial Sequence: Synthetic peptide"
AKAGPAAAYGWYYYYMDV

SEQ ID NO: 1859 - protein, 108 aa, Artificial Sequence
  source: /note="Description of Artificial Sequence: Synthetic polypeptide"
DIQMTQSPSSLSASVGDRVTITCRASQGISNYLAWYQQKPGKVPKLLIYAASTLQSGVPSRFSGSGSGTDFTLTISSLQPEDVSTYYCQKYNSALGFTFGPGTKVDIK

SEQ ID NO: 1860 - protein, 10 aa, Artificial Sequence
  source: /note="Description of Artificial Sequence: Synthetic peptide"
QKYNSALGFT

SEQ ID NO: 1861 - protein, 120 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGTDSVKGRFTISRDTSKNMLYLQMNSLRAEDTAVYYCAKGPRFGWSYRGGPGFDIWGQGTMVTVSS

SEQ ID NO: 1862 - protein, 18 aa, Artificial Sequence
  source: /note="Description of Artificial Sequence: Synthetic peptide"
AKGPRFGWSYRGGPGFDI

SEQ ID NO: 1863 - protein, 107 aa, Artificial Sequence; identical to SEQ ID NO: 555
  source: /note="Description of Artificial Sequence: Synthetic polypeptide"

SEQ ID NO: 1864 - protein, 9 aa, Artificial Sequence
  source: /note="Description of Artificial Sequence: Synthetic peptide"
QQYDNLPIT

SEQ ID NO: 1865 - protein, 119 aa, Artificial Sequence; identical to SEQ ID NO: 113
  source: /note="Description of Artificial Sequence: Synthetic polypeptide"

SEQ ID NO: 1866 - protein, 12 aa, Artificial Sequence
  source: /note="Description of Artificial Sequence: Synthetic peptide"
ASSSGYLFHSDY

SEQ ID NO: 1867 - protein, 107 aa, Artificial Sequence
  source: /note="Description of Artificial Sequence: Synthetic polypeptide"
  MOD_RES (52)..(52): Any amino acid
DIQMTQSPSTLSASVGDRVTITCRASQSISNWLAWFQQKPGKAPKLLIYEAXSLESGVPSRFSGSGSGTEFTLTISSLQPDDFATYYCQQYNSYPWTFGQGTKVEIK

SEQ ID NO: 1868 - protein, 9 aa, Artificial Sequence
  source: /note="Description of Artificial Sequence: Synthetic peptide"
QQYNSYPWT

SEQ ID NO: 1869 - protein, 125 aa, Artificial Sequence; identical to SEQ ID NO: 101
  source: /note="Description of Artificial Sequence: Synthetic polypeptide"

SEQ ID NO: 1870 - protein, 18 aa, Artificial Sequence
  source: /note="Description of Artificial Sequence: Synthetic peptide"
AKGPRFGWSYRGGSGFDI

SEQ ID NO: 1871 - protein, 107 aa, Artificial Sequence; identical to SEQ ID NO: 102
  source: /note="Description of Artificial Sequence: Synthetic polypeptide"

SEQ ID NO: 1872 - protein, 9 aa, Artificial Sequence
  source: /note="Description of Artificial Sequence: Synthetic peptide"
QQYDNLPIT

SEQ ID NO: 1873 - protein, 127 aa, Artificial Sequence
  source: /note="Description of Artificial Sequence: Synthetic polypeptide"
QVQLVESGGGVVQPGRSLRLSCAVSGFTFSSYGMHWVRQAPGKGLEWVAVISYDGSNKHYADSVKGRFTISRDNSKNTLYVQMNSLRAEDTAMYYCAKQLGLYCSGGNCYSGALDYWGQGTLVTVSS

SEQ ID NO: 1874 - protein, 20 aa, Artificial Sequence
  source: /note="Description of Artificial Sequence: Synthetic peptide"
AKQLGLYCSGGNCYSGALDY

SEQ ID NO: 1875 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPFTFGPGTKVDIK

SEQ ID NO: 1876 - protein, 9 aa, Artificial Sequence
  source: /note="Description of Artificial Sequence: Synthetic peptide"
QQYDNLPFT

SEQ ID NO: 1877 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNMLYLQMNSLRAEDTAVYYCAKQNGLYCSGGSCYLGYFDYWGQGTLVTVSS

SEQ ID NO: 1878 - protein, 20 aa, Artificial Sequence
  source: /note="Description of Artificial Sequence: Synthetic peptide"
AKQNGLYCSGGSCYLGYFDY

SEQ ID NO: 1879 - protein, 107 aa, Artificial Sequence
  source: /note="Description of Artificial Sequence: Synthetic polypeptide"
DIQMTQSPSSLSASVGDRVTITCQASQDISNYLNWFQQKPGKAPKLLIYAASDLETGVPSRFSGSGSGTDFTFTISSLQPEDIASYYCLQYDNLPLTFGGGTKVEIK

SEQ ID NO: 1880 - protein, 9 aa, Artificial Sequence
  source: /note="Description of Artificial Sequence: Synthetic peptide"
LQYDNLPLT

SEQ ID NO: 1881 - protein, 121 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYSADSVKGRFTISRDNSKNTLYLQMNSLRAEDTAVYYCAKGGAYSYYYYMDVWGKGTTVTVSS

SEQ ID NO: 1882 - protein, 14 aa, Artificial Sequence
  source: /note="Description of Artificial Sequence: Synthetic peptide"
AKGGAYSYYYYMDV

SEQ ID NO: 1883 - protein, 107 aa, Artificial Sequence; identical to SEQ ID NO: 118
  source: /note="Description of Artificial Sequence: Synthetic polypeptide"

SEQ ID NO: 1884 - protein, 9 aa, Artificial Sequence
  source: /note="Description of Artificial Sequence: Synthetic peptide"
QQYDNLPLT

SEQ ID NO: 1885 - protein, 121 aa, Artificial Sequence
  source: /note="Description of Artificial Sequence: Synthetic polypeptide"
QVQLVESGGGVVQPGRSLRLSCAASGFTFSSYTMHWVRQAPGKGLEWVAVISYDGSIKYYADSVKGRFTISRDNSKNTLYLQMNSLRAEDTAVYYCARDSDTAMVDYFDYWGQGTLVTVSS

SEQ ID NO: 1886 - protein, 14 aa, Artificial Sequence
  source: /note="Description of Artificial Sequence: Synthetic peptide"
ARDSDTAMVDYFDY

SEQ ID NO: 1887 - protein, 108 aa, Artificial Sequence
  source: /note="Description of Artificial Sequence: Synthetic polypeptide"
DIQMTQSPSSLSASVGDRVTITCRASQSISSYLNWYQQKAGKAPKLLIYAASSLQSGVPSRFSGSGSGTDFTLTISSLQPEDFATYYCQQSYSTFMYTFGQGTKLEIK

SEQ ID NO: 1888 - protein, 10 aa, Artificial Sequence
  source: /note="Description of Artificial Sequence: Synthetic peptide"
QQSYSTFMYT

SEQ ID NO: 1889 - protein, 123 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRCTISRDNSKNTLFLQMNSLRPEDTAVYYCAKVDLKYSYGLYYFDYWGQGTLVTVSS

SEQ ID NO: 1890 - protein, 16 aa, Artificial Sequence
  source: /note="Description of Artificial Sequence: Synthetic peptide"
AKVDLKYSYGLYYFDY

SEQ ID NO: 1891 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQTYITPPSFGPGTKVDIK

SEQ ID NO: 1892 - protein, 9 aa, Artificial Sequence
  source: /note="Description of Artificial Sequence: Synthetic peptide"
QQTYITPPS

SEQ ID NO: 1893 - protein, 119 aa, Artificial Sequence
  source: /note="Description of Artificial Sequence: Synthetic polypeptide"
QVQLVESGGGVVQPGRSLRLSCAASGFTFSHYAMHWVRQAPGKGLEWVAVIPFDGSNKYYADSVKGRFTISRDNSKNTLYLQMNSLRAEDTAVYYCASSSGYLFHFDYWGQGTLVTVSS

SEQ ID NO: 1894 - protein, 12 aa, Artificial Sequence
  source: /note="Description of Artificial Sequence: Synthetic peptide"
ASSSGYLFHFDY

SEQ ID NO: 1895 - protein, 107 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIK

SEQ ID NO: 1896 - protein, 9 aa, Artificial Sequence
  source: /note="Description of Artificial Sequence: Synthetic peptide"
QQYNSYPWT

SEQ ID NO: 1897 - protein, 123 aa, Artificial Sequence
  source: /note="Description of Artificial Sequence: Synthetic polypeptide"
QVQLVESGGGVVQPGRSLRLSCAASGFTFSNYAMHWVRQAPGKGLEWVAVISYDGSKKYSADSVKGRFTISRDNSKNTLYLQMNSLRPVDTAVYYCARVRLGAYYNYFGMDVWGQGTTVTVSS

SEQ ID NO: 1898 - protein, 16 aa, Artificial Sequence
  source: /note="Description of Artificial Sequence: Synthetic peptide"
ARVRLGAYYNYFGMDV

SEQ ID NO: 1899 - protein, 111 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTFTFGPGTKVDIK

SEQ ID NO: 1900 - protein, 8 aa, Artificial Sequence
  source: /note="Description of Artificial Sequence: Synthetic peptide"
MQALQTFT

SEQ ID NO: 1901 - protein, 126 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKKGQPYCGGDCYFYYFDYWGQGTLVTVSS

SEQ ID NO: 1902 - protein, 19 aa, Artificial Sequence
  source: /note="Description of Artificial Sequence: Synthetic peptide"
AKKGQPYCGGDCYFYYFDY

SEQ ID NO: 1903 - protein, 108 aa, Artificial Sequence
  source: /note="Description of Artificial Sequence: Synthetic polypeptide"
DIQMTQSPSSLSASLGDRVTITCQASQDISNYLNWYQQKPGKAPKLLIYDASNLETGVPSRFSGSGSGTDFTFTISSLQPEDIATYYCQQYDNLPPITFGQGTRLEIK

SEQ ID NO: 1904 - protein, 10 aa, Artificial Sequence
  source: /note="Description of Artificial Sequence: Synthetic peptide"
QQYDNLPPIT

SEQ ID NO: 1905 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGTGIAAAGTANPPFDYWGQGTLVTVSS

SEQ ID NO: 1906 - protein, 19 aa, Artificial Sequence
  source: /note="Description of Artificial Sequence: Synthetic peptide"
ARDGTGIAAAGTANPPFDY

SEQ ID NO: 1907 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 1908 - protein, 9 aa, Artificial Sequence
  source: /note="Description of Artificial Sequence: Synthetic peptide"
QQYDNLPYT

SEQ ID NO: 1909 - protein, 119 aa, Artificial Sequence
  source: /note="Description of Artificial Sequence: Synthetic polypeptide"
QVQLVESGGGVVQPGRSLRLSCAASGFTFSTYGMHWVRQAPGKGLEWVAVIWYDGNNKYYADSVKGRFTISRDNSKNTLYLQMNSLRAEDTAVYYCATSLFGIISLDYWGQGTLVTVSS

SEQ ID NO: 1910 - protein, 12 aa, Artificial Sequence
  source: /note="Description of Artificial Sequence: Synthetic peptide"
ATSLFGIISLDY

SEQ ID NO: 1911 - protein, 107 aa, Artificial Sequence
  source: /note="Description of Artificial Sequence: Synthetic polypeptide"
AIQMTQSPSSLSASVGDRVTITCRAGQGIRNDLGWYQQKPGKAPKLLIYAASSLQSGVPSRFSGSGSGTDFTLTISSLQPEDFATYYCLQDYNYPYTFGQGTKLEIK

SEQ ID NO: 1912 - protein, 9 aa, Artificial Sequence
  source: /note="Description of Artificial Sequence: Synthetic peptide"
LQDYNYPYT

SEQ ID NO: 1913 - protein, 120 aa, Artificial Sequence
  source: /note="Description of Artificial Sequence: Synthetic polypeptide"
QVQLVESGGGVVQPGRSLRLSCAASGFTFNNYGMHWVRQAPGKGLEWVAVIWYDGSNKYYADSVKGRFTISRDNSKNTVYLQMNSLRAEDTAVYYCARDWEIVVAGMDVWGQGTTVTVSS

SEQ ID NO: 1914 - protein, 13 aa, Artificial Sequence
  source: /note="Description of Artificial Sequence: Synthetic peptide"
ARDWEIVVAGMDV

SEQ ID NO: 1915 - protein, 112 aa, Artificial Sequence
  source: /note="Description of Artificial Sequence: Synthetic polypeptide"
DVVMTQSPLSLPVTLGQPASISCRSSQSLVYNDGNTYLNWFQQRPGQSPRRLIYKVSNRDSGVPDRFSGSGSGTDFTLKISRVEAEDVGVYYCMQGTHCPFTFGPGTKVDIK

SEQ ID NO: 1916 - protein, 9 aa, Artificial Sequence
  source: /note="Description of Artificial Sequence: Synthetic peptide"
MQGTHCPFT

SEQ ID NO: 1917 - protein, 125 aa, Artificial Sequence
  source: /note="Description of Artificial Sequence: Synthetic polypeptide"
EVQLVESGGVVVQPGGSLRLSCAASGFTFDDHTMHWVRQAPGKGLEWVSLISWDAGSTYYADSVKGRFTISRDNRKNFLYLQMNSLRTEDTALYYCAKGLNYRPQYYYYYGMDVWGQGTTVTVSS

SEQ ID NO: 1918 - protein, 18 aa, Artificial Sequence
  source: /note="Description of Artificial Sequence: Synthetic peptide"
AKGLNYRPQYYYYYGMDV

SEQ ID NO: 1919 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 1920 - protein, 9 aa, Artificial Sequence
  source: /note="Description of Artificial Sequence: Synthetic peptide"
MQALQTPWT

SEQ ID NO: 1921 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWISVIYSGGSTFYADSVKGRFTISRDNSKDTLYLQMNRLRAEDTAVYYCARSFYFDAFDIWGQGTMVTVSS

SEQ ID NO: 1922 - protein, 11 aa, Artificial Sequence
  source: /note="Description of Artificial Sequence: Synthetic peptide"
ARSFYFDAFDI

SEQ ID NO: 1923 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPLLTFGGGTKVEIK

SEQ ID NO: 1924 - protein, 10 aa, Artificial Sequence
  source: /note="Description of Artificial Sequence: Synthetic peptide"
QQLNSYPLLT

SEQ ID NO: 1925 - protein, 118 aa, Artificial Sequence
  source: /note="Description of Artificial Sequence: Synthetic polypeptide"
EVQLVESGGGLIQPGGSLRLSCAASGFIVSRNYMSWVRQAPGKGLEWVSVIYSGGSTYYADSVKGRFTISRDNSKNTLYLQMNSLRADDTAVYYCTRDPVPGRGDAYWGQGTLVTVSS

SEQ ID NO: 1926 - protein, 12 aa, Artificial Sequence
  source: /note="Description of Artificial Sequence: Synthetic peptide"
TRDPVPGRGDAY

SEQ ID NO: 1927 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISTLQPEDIATYYCQQYDNLPITFGGGTKVEIK

SEQ ID NO: 1928 - protein, 9 aa, Artificial Sequence
  source: /note="Description of Artificial Sequence: Synthetic peptide"
QQYDNLPIT

SEQ ID NO: 1929 - protein, 116 aa, Artificial Sequence
  source: /note="Description of Artificial Sequence: Synthetic polypeptide"
EVQLVETGGGLIQPGGSLRLSCAASGITVSSNYMSWVRQAPGKGLEWVSIIYSGGSTFYADSVKGRFTISRDNPKNTLYLQMNSLRAEDTAVYYCARDLYYYGMDVWGQGTTVTVS

SEQ ID NO: 1930 - protein, 11 aa, Artificial Sequence
  source: /note="Description of Artificial Sequence: Synthetic peptide"
ARDLYYYGMDV

SEQ ID NO: 1931 - protein, 106 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPTFGQGTKLEIK

SEQ ID NO: 1932 - protein, 8 aa, Artificial Sequence
  source: /note="Description of Artificial Sequence: Synthetic peptide"
QQLNSYPT

SEQ ID NO: 1933 - protein, 120 aa, Artificial Sequence
  source: /note="Description of Artificial Sequence: Synthetic polypeptide"
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKDITMIVDVFEYWGQGTLVTVSS

SEQ ID NO: 1934 - protein, 13 aa, Artificial Sequence
  source: /note="Description of Artificial Sequence: Synthetic peptide"
VKDITMIVDVFEY

SEQ ID NO: 1935 - protein, 107 aa, Artificial Sequence
  source: /note="Description of Artificial Sequence: Synthetic polypeptide"
DIQMTQSPSSLSASVGDRVTITCRASQSISNYLNWYQQKPGKAPKLLIYAASSLQSAVPSRFSGSGSGTDFTLTISSLQPEDFATYFCQQSYTTPYTFGQGTKLEIK

SEQ ID NO: 1936 - protein, 9 aa, Artificial Sequence
  source: /note="Description of Artificial Sequence: Synthetic peptide"
QQSYTTPYT

SEQ ID NO: 1937 - protein, 116 aa, Artificial Sequence
  source: /note="Description of Artificial Sequence: Synthetic polypeptide"
EVQLVESGGGLVQPGGSLRLSCAASEFIVSRNYMSWVRQAPGKGLEWVSLIYSGGSTYYADSVKGRFTISRDNSKNTLYLQMNSLRAEDTAMYYCARDIAGRLDYWGQGTLVTVSS

SEQ ID NO: 1938 - protein, 10 aa, Artificial Sequence
  source: /note="Description of Artificial Sequence: Synthetic peptide"
ARDIAGRLDY

SEQ ID NO: 1939 - protein, 108 aa, Artificial Sequence
  source: /note="Description of Artificial Sequence: Synthetic polypeptide"
DIQMTQSPSSLSASVGDRVTITCQASQDISKYLNWYQQKPGKAPKLLIYDASNLETGVPSRFSGSGSGTDFTFTISSLQPEDFATYYCQHYDSLSRLTFGGGTKVEIK

SEQ ID NO: 1940 - protein, 10 aa, Artificial Sequence
  source: /note="Description of Artificial Sequence: Synthetic peptide"
QHYDSLSRLT

SEQ ID NO: 1941 - protein, 117 aa, Artificial Sequence
  source: /note="Description of Artificial Sequence: Synthetic polypeptide"
EVQLVESGGGLVQPGGSLRLSCAASGFIVSSNYMSWVRQAPGKGLEWVSILYSGGSTYYADSVKGRFTISRDNSKNTLYLQMNSLRAEDTAVYYCARDLVVYGADYWGQGTLVTVSS

SEQ ID NO: 1942 - protein, 11 aa, Artificial Sequence
  source: /note="Description of Artificial Sequence: Synthetic peptide"
ARDLVVYGADY

SEQ ID NO: 1943 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPPFGGGTKVEIK

SEQ ID NO: 1944 - protein, 9 aa, Artificial Sequence
  source: /note="Description of Artificial Sequence: Synthetic peptide"
QQLNSYPPP

SEQ ID NO: 1945 - protein, 117 aa, Artificial Sequence
  source: /note="Description of Artificial Sequence: Synthetic polypeptide"
EVQLVESGGDLVQPGGSLRLSCAASGLTVSSNYMSWVRQAPGKGLEWVSVIYSGGSTFYADSVKGRFTISRDNSQNTLYLQMNSLRAEDTAVYYCARDLQYYGMDVWGQGTTVTVSS

SEQ ID NO: 1946 - protein, 11 aa, Artificial Sequence
  source: /note="Description of Artificial Sequence: Synthetic peptide"
ARDLQYYGMDV

SEQ ID NO: 1947 - protein, 105 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQPDSFTFGPGTKVDIK

SEQ ID NO: 1948 - protein, 7 aa, Artificial Sequence
  source: /note="Description of Artificial Sequence: Synthetic peptide"
QQPDSFT

SEQ ID NO: 1949 - protein, 122 aa, Artificial Sequence
  source: /note="Description of Artificial Sequence: Synthetic polypeptide"
EVQLVESGGGLVQPGGSLRLSCAASGFTFSSYWMSWVRQAPGKGLEWVANIKQDGSVKYYVDSVKGRFTISRDNAKNSLYLQMNSLRDEDTAVYYCARDQVSWYNLDAFDIWGQGTMVTVSS

SEQ ID NO: 1950 - protein, 15 aa, Artificial Sequence
  source: /note="Description of Artificial Sequence: Synthetic peptide"
ARDQVSWYNLDAFDI

SEQ ID NO: 1951 - protein, 112 aa, Artificial Sequence
  source: /note="Description of Artificial Sequence: Synthetic polypeptide"
DVVMTQSPLSLPVTLGQPASISCRSSQSLVYSDGDTYLNWFQQRPGQSPRRLIYKVSNRDSGVPDRFSGSGSGTDFTLKISRVEAEDVGVYYCMQGTHWPKTFGQGTKLEIK

SEQ ID NO: 1952 - protein, 9 aa, Artificial Sequence
  source: /note="Description of Artificial Sequence: Synthetic peptide"
MQGTHWPKT

SEQ ID NO: 1953 - protein, 124 aa, Artificial Sequence
  source: /note="Description of Artificial Sequence: Synthetic polypeptide"
QVQLQESGPGLVKPSQTLSLTCTVSGGSISSGDYSWSWIRQPPGKGLEWIGYIYYSGSTYYNPSLKSRVTISVDTSKNQFSLKLSSVTAADTAVYYCVRVVMSGIAAAGQNDYWGQGTLVTVSS

SEQ ID NO: 1954 - protein, 16 aa, Artificial Sequence
  source: /note="Description of Artificial Sequence: Synthetic peptide"
VRVVMSGIAAAGQNDY

SEQ ID NO: 1955 - protein, 109 aa, Artificial Sequence
  source: /note="Description of Artificial Sequence: Synthetic polypeptide"
DIQMTQSPSSLSASVGDRVTITCQASQDISSYLNWYQQKPGKAPKLLIYDASNLETGVPSRFSGSGSGTDFTFTISSLQPEDIATYYCQQYDILPPMYTFGQGTKLEIK

SEQ ID NO: 1956 - protein, 11 aa, Artificial Sequence
  source: /note="Description of Artificial Sequence: Synthetic peptide"
QQYDILPPMYT

SEQ ID NO: 1957 - protein, 127 aa, Artificial Sequence
  source: /note="Description of Artificial Sequence: Synthetic polypeptide"
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARTYYYDSSGYYFQYYFDCWGQGTLVTVSS

SEQ ID NO: 1958 - protein, 19 aa, Artificial Sequence
  source: /note="Description of Artificial Sequence: Synthetic peptide"
ARTYYYDSSGYYFQYYFDC

SEQ ID NO: 1959 - protein, 108 aa, Artificial Sequence
  source: /note="Description of Artificial Sequence: Synthetic polypeptide"
EIVLTQSPGTLSLSPGERATLSCRASLSVSSSYLAWYQQKPGQAPRLLIYGASSRATGIPDRFSGSGSGTDFTLTISRLEPEDFAVYYCQQYGSSPLTFGGGTKVEIK

SEQ ID NO: 1960 - protein, 9 aa, Artificial Sequence
  source: /note="Description of Artificial Sequence: Synthetic peptide"
QQYGSSPLT

SEQ ID NO: 1961 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKKQFSLKLSSVTAADTAVYYCATNYDDYVPAEYFQDWGQGTLVTVSS

SEQ ID NO: 1962 - protein, 15 aa, Artificial Sequence
  source: /note="Description of Artificial Sequence: Synthetic peptide"
ATNYDDYVPAEYFQD

SEQ ID NO: 1963 - protein, 108 aa, Artificial Sequence [sequence omitted]

SEQ ID NO: 1964 - protein, 10 aa, Artificial Sequence
  source: /note="Description of Artificial Sequence: Synthetic peptide"
QQRSNWPPLT

SEQ ID NO: 1965 - protein, 121 aa, Artificial Sequence
  source: /note="Description of Artificial Sequence: Synthetic polypeptide"
QVQLQESGPGLVKPSQTLSLTCTFSGGSISSGGHYWSWIRQHPGKGLEWIGYIYYSGSTYYNPSLKSRVIISVDTSKNQFSLRLSSVTAADTAVYYCARSCSSTSCPFDYWGQGTLVTVSS

SEQ ID NO: 1966 - protein, 13 aa, Artificial Sequence
  source: /note="Description of Artificial Sequence: Synthetic peptide"
ARSCSSTSCPFDY

SEQ ID NO: 1967 - protein, 107 aa, Artificial Sequence
  source: /note="Description of Artificial Sequence: Synthetic polypeptide"
DIQMTQSPSSLSASVGDRVTITCQASQDISNSLNWYQQKPGKAPKVLIYDASNLETGVPSRFSGSGSGTDFTFTISSLQPEDFATYYCQQYDNLPFTFGPGTKVDIK

SEQ ID NO: 1968 - protein, 9 aa, Artificial Sequence
  source: /note="Description of Artificial Sequence: Synthetic peptide"
QQYDNLPFT

SEQ ID NO: 1969 - protein, 121 aa, Artificial Sequence
  source: /note="Description of Artificial Sequence: Synthetic polypeptide"
QLQLQESGPGLVKPSETLSLTCTVSGGSISSSSYYWGWIRQSPGKGLEWIGSIYYSGSTYYNPSLKSRVTISVDTSKNQFSLKLSSVTAADTAVYYCARRPPGDYYYMDVWGKGTTVTVSS

SEQ ID NO: 1970 - protein, 13 aa, Artificial Sequence
  source: /note="Description of Artificial Sequence: Synthetic peptide"
ARRPPGDYYYMDV

SEQ ID NO: 1971 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSIPQITFGQGTRLEIK

SEQ ID NO: 1972 - protein, 10 aa, Artificial Sequence
  source: /note="Description of Artificial Sequence: Synthetic peptide"
QQSYSIPQIT

SEQ ID NO: 1973 - protein, 124 aa, Artificial Sequence
  source: /note="Description of Artificial Sequence: Synthetic polypeptide"
QVQLQQSGPGLVKPSQTLSLTCAISGDSVSSNSTAWNWIRQSPSRGLEWLGRTYYRSKWYNHYALSVKSRITINPDTSKNQFSLQLNSVTPEDTAVYYCARSGSYYISHGMDVWGQGTTVTVSS

SEQ ID NO: 1974 - protein, 14 aa, Artificial Sequence
  source: /note="Description of Artificial Sequence: Synthetic peptide"
ARSGSYYISHGMDV

SEQ ID NO: 1975 - protein, 108 aa, Artificial Sequence
  source: /note="Description of Artificial Sequence: Synthetic polypeptide"
EIVMTQSPATLSVSPGERATLSCRASQSVSSNLAWYQQRPGQAPRLLIYGASTRATGIPARFSGSGSGTEFTLTISSLQSEDFAVYYCQQYNNWPPWTFGQGTKVEIK

SEQ ID NO: 1976 - protein, 10 aa, Artificial Sequence [sequence omitted]

SEQ ID NO: 1977 - protein, 126 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARNDGSSGWYPERGGGFDYWGQGTLVTVSS

SEQ ID NO: 1978 - protein, 19 aa, Artificial Sequence
  source: /note="Description of Artificial Sequence: Synthetic peptide"
ARNDGSSGWYPERGGGFDY

SEQ ID NO: 1979 - protein, 112 aa, Artificial Sequence
  source: /note="Description of Artificial Sequence: Synthetic polypeptide"
QSVLTQPPSVSGAPGQRVTISCTGSSSNIGAGYDVKWYQQLPGTAPKLLIYGNSNRPSGVPDRFSGSKSGTSASLAITGLQAEDEADYYCQSYDSSLSGLWVFGGGTKLTVL

SEQ ID NO: 1980 - protein, 12 aa, Artificial Sequence
  source: /note="Description of Artificial Sequence: Synthetic peptide"
QSYDSSLSGLWV

SEQ ID NO: 1981 - protein, 121 aa, Artificial Sequence
  source: /note="Description of Artificial Sequence: Synthetic polypeptide"
QVQLVESGGGVVQPGRSLRLSCAASGFTFSSYAIHWVRQAPGKGLEWVAVISNDGSNKYYEDSVKGRFTFSRDNSKNTLYLQMNSLRAEDTAVYYCARALSFIAVAGIDYWGRGTLVTVSS

SEQ ID NO: 1982 - protein, 14 aa, Artificial Sequence
  source: /note="Description of Artificial Sequence: Synthetic peptide"
ARALSFIAVAGIDY

SEQ ID NO: 1983 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTIVIYEDNQRPSGVPDRFSGSIDSSSNSASLTISGLKTEDEADYYCQSYDSTTHVVFGGGTKLIVL

SEQ ID NO: 1984 - protein, 10 aa, Artificial Sequence
  source: /note="Description of Artificial Sequence: Synthetic peptide"
QSYDSTTHVV

SEQ ID NO: 1985 - protein, 124 aa, Artificial Sequence
  source: /note="Description of Artificial Sequence: Synthetic polypeptide"
QVQLVESGGGVVQPGRSLRLSCAASGFTFSSYAMFWVRQAPGKGLEWVAVISYDGSNKYYADSVKGRFTISRDNSKNTLYLQMNSLRAEDTAVYYCARADLGYCTNGVCYVDYWGQGTLVTVSS

SEQ ID NO: 1986 - protein, 17 aa, Artificial Sequence
  source: /note="Description of Artificial Sequence: Synthetic peptide"
ARADLGYCTNGVCYVDY

SEQ ID NO: 1987 - protein, 110 aa, Artificial Sequence; identical to SEQ ID NO: 116
  source: /note="Description of Artificial Sequence: Synthetic polypeptide"

SEQ ID NO: 1988 - protein, 9 aa, Artificial Sequence
  source: /note="Description of Artificial Sequence: Synthetic peptide"
QSYDSSNWV

SEQ ID NO: 1989 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSVIYSGGSTYYADSVKGRFTISRDNSKNTLYLHMNSLRAEDTAVFYCASHLMPDAFDIWGQGTMVTVSS

SEQ ID NO: 1990 - protein, 11 aa, Artificial Sequence
  source: /note="Description of Artificial Sequence: Synthetic peptide"
ASHLMPDAFDI

SEQ ID NO: 1991 - protein, 112 aa, Artificial Sequence
  source: /note="Description of Artificial Sequence: Synthetic polypeptide"
QSVLTQPASVSGSPGQSITISCTGTSSDVGSYNLVSWYQQHPGKAPKLMIYEVSKRPSGVSNRFSGSKSGNTASLTISGLQAEDEADYYCCSYGGSSTSFYVFGTGTKVTVL

SEQ ID NO: 1992 - protein, 12 aa, Artificial Sequence
  source: /note="Description of Artificial Sequence: Synthetic peptide"
CSYGGSSTSFYV

SEQ ID NO: 1993 - protein, 125 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARVVGYDFWSGYDGGYFDYWGQGTLVTVSS

SEQ ID NO: 1994 - protein, 19 aa, Artificial Sequence
  source: /note="Description of Artificial Sequence: Synthetic peptide"
ARVVGYDFWSGYDGGYFDY

SEQ ID NO: 1995 - protein, 110 aa, Artificial Sequence
  source: /note="Description of Artificial Sequence: Synthetic polypeptide"
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTWVFGGGTKLTVL

SEQ ID NO: 1996 - protein, 10 aa, Artificial Sequence
  source: /note="Description of Artificial Sequence: Synthetic peptide"
CSYAGSSTWV

SEQ ID NO: 1997 - protein, 126 aa, Artificial Sequence
  source: /note="Description of Artificial Sequence: Synthetic polypeptide"
QVQLVESGGGVVQPGRSLRLSCVASGFTFSSYGMHWVRQAPGKGLEWVAVIWYDGSNKYYADSVKGRFTISRDNSKNTLYLKMNSLRAEDTAVYYCARGEWDSGSYQYYDYYMDVWGKGTTVTVSS

SEQ ID NO: 1998 - protein, 19 aa, Artificial Sequence
  source: /note="Description of Artificial Sequence: Synthetic peptide"
ARGEWDSGSYQYYDYYMDV

SEQ ID NO: 1999 - protein, 110 aa, Artificial Sequence
  source: /note="Description of Artificial Sequence: Synthetic polypeptide"
QSVLTQEPSFSVSPGGTVTLTCGLSSGSVSTSYYPSWYQQTPGQPPRTLIYITNTRSSGVPDRFSGSILGNKAALTITGAQADDESDYYCVLYMGSSNWVFGGGTKLTVL

SEQ ID NO: 2000 - protein, 10 aa, Artificial Sequence
  source: /note="Description of Artificial Sequence: Synthetic peptide"
VLYMGSSNWV

SEQ ID NO: 2001 - protein, 125 aa, Artificial Sequence
  source: /note="Description of Artificial Sequence: Synthetic polypeptide"
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTGRITFGGGDDAFDIWGQGTMVTVSS

SEQ ID NO: 2002 - protein, 18 aa, Artificial Sequence
  source: /note="Description of Artificial Sequence: Synthetic peptide"
ARDTGRITFGGGDDAFDI

SEQ ID NO: 2003 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSKSGNTATLTISRVEAGDEADYYCQVWDSSSDHRVFGGGTKLTVL

SEQ ID NO: 2004 - protein, 11 aa, Artificial Sequence
  source: /note="Description of Artificial Sequence: Synthetic peptide"
QVWDSSSDHRV

SEQ ID NO: 2005 - protein, 122 aa, Artificial Sequence
  source: /note="Description of Artificial Sequence: Synthetic polypeptide"
QVQLQESGPGLVKPSQTLSLTCTVSGGSISSGGYYWNWIRQHPGKGLEWIGYIYYSGSTYYNPSLKSRVTISVDTSQNQFSLRLSSVTAADTAVYYCARGVVLITDYYFDYWGQGTLVTVSS

SEQ ID NO: 2006 - protein, 14 aa, Artificial Sequence
  source: /note="Description of Artificial Sequence: Synthetic peptide"
ARGVVLITDYYFDY

SEQ ID NO: 2007 - protein, 106 aa, Artificial Sequence
  source: /note="Description of Artificial Sequence: Synthetic polypeptide"
SYVLTQPPSVSVSPGQTARITCSGDTLPKQYVYWYQQKPGQAPALVIYKDSERPSGIPERLSGSSSGTTATLTISGVQAEDEADYYCQSADSSGTRFGGGTKLTVL

SEQ ID NO: 2008 - protein, 9 aa, Artificial Sequence
  source: /note="Description of Artificial Sequence: Synthetic peptide"
QSADSSGTR

SEQ ID NO: 2009 - protein, 119 aa, Artificial Sequence
  source: /note="Description of Artificial Sequence: Synthetic polypeptide"
QVQLQQWGAGLLKPSETLSLTCAVYGGSFSAYSWSWIRQPPGKGLEWIGEINHGGSTNYNASLKSRVTISADTSKNLFSLKLSSVTAADTAVYYCAREGAVAGGDFDYWGQGTLVTVSS

SEQ ID NO: 2010 - protein, 13 aa, Artificial Sequence
  source: /note="Description of Artificial Sequence: Synthetic peptide"
AREGAVAGGDFDY

SEQ ID NO: 2011 - protein, 110 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDGTSDHPGWVFGGGTKLTVL

SEQ ID NO: 2012 - protein, 13 aa, Artificial Sequence
  source: /note="Description of Artificial Sequence: Synthetic peptide"
QVWDGTSDHPGWV

SEQ ID NO: 2013 - protein, 118 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTRYNPSLKSRVTISVDTSKNQFSLKLSSVTAADTAVFYCARGRGLPPWFDPWGQGTLVTVSS

SEQ ID NO: 2014 - protein, 12 aa, Artificial Sequence
  source: /note="Description of Artificial Sequence: Synthetic peptide"
ARGRGLPPWFDP

SEQ ID NO: 2015 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKLTVL

SEQ ID NO: 2016 - protein, 9 aa, Artificial Sequence
  source: /note="Description of Artificial Sequence: Synthetic peptide"
QSYDSSNVV

SEQ ID NO: 2017 - protein, 124 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARPDMSSSSSPHYWYFDLWGRGTLVTVSS

SEQ ID NO: 2018 - protein, 18 aa, Artificial Sequence
  source: /note="Description of Artificial Sequence: Synthetic peptide"
ARPDMSSSSSPHYWYFDL

SEQ ID NO: 2019 - protein, 110 aa, Artificial Sequence
  source: /note="Description of Artificial Sequence: Synthetic polypeptide"
SYVLTQPPSVSVAPGKTARITCGGNNIGSKNVHWYQQKPGQAPVLVVYYDSDRPSGIPERFSGSNSGNTATLTISRVEAGDEADYYCQVWDSSSGHFHVVFGGGTKLTVL

SEQ ID NO: 2020 - protein, 13 aa, Artificial Sequence
  source: /note="Description of Artificial Sequence: Synthetic peptide"
QVWDSSSGHFHVV

SEQ ID NO: 2021 - protein, 123 aa, Artificial Sequence
  source: /note="Description of Artificial Sequence: Synthetic polypeptide"
EVQLVQSGAEVKKPGESLKISCKGSGYSFTSYWIVWVRQMPGKGLERMGIIYPGDSDTRYSPSFQGQVTISADKSISTAYLQWSSLKASDTAMYYCARRGGSYYNNGDGMDVWGQGTTVTVSS

SEQ ID NO: 2022 - protein, 16 aa, Artificial Sequence
  source: /note="Description of Artificial Sequence: Synthetic peptide"
ARRGGSYYNNGDGMDV

SEQ ID NO: 2023 - protein, 108 aa, Artificial Sequence
  source: /note="Description of Artificial Sequence: Synthetic polypeptide"
SYVLTQPPSVSVSPGQTASITCFGDKLGDKYACWYQQKPGQSPVLVIYQDSKRPSGIPERFSGSNSGNTATLTISGTQAMDEADYYCQAWDSSTPHVVFGGGTKLTVL

SEQ ID NO: 2024 - protein, 11 aa, Artificial Sequence
  source: /note="Description of Artificial Sequence: Synthetic peptide"
QAWDSSTPHVV

SEQ ID NO: 2025 - protein, 124 aa, Artificial Sequence
  source: /note="Description of Artificial Sequence: Synthetic polypeptide"
EVQLVESGGGLVKPGGSLRLSCAAASGFTISNAWMSWVRQAPGKGLEWVGRIKSKTDGGTTDYAAPVKGRFTISRDNSKNTLYLQMNSLKTEDTAVYYCTTDYSIRYYYGMDVWGQGTTVTVSS

SEQ ID NO: 2026 - protein, 14 aa, Artificial Sequence
  source: /note="Description of Artificial Sequence: Synthetic peptide"
TTDYSIRYYYGMDV

SEQ ID NO: 2027 - protein, 108 aa, Artificial Sequence
  source: /note="Description of Artificial Sequence: Synthetic polypeptide"
SYVLTQPPSVAVSPGQTARITCSGDALPKQYAYWYQQKPGQAPVLVIYKDSERPSGIPERFSGSSSGTTVTLTISGVQAEDEADYYCQSADSSGTYEVFGGGTKVTVL

SEQ ID NO: 2028 - protein, 11 aa, Artificial Sequence
  source: /note="Description of Artificial Sequence: Synthetic peptide"
QSADSSGTYEV

SEQ ID NO: 2029 - protein, 125 aa, Artificial Sequence
  source: /note="Description of Artificial Sequence: Synthetic polypeptide"
EVQLVESGGGLVKPGGSLRLSCAASGFTFSTYSMNWVRQAPGKGLEWVSSISSSSNYIYYADSVKGRFTISRDNAKNSLYLQMNSLRAEDTAVYYCARAKLEIAHYGGSPGFDYWGQGTLVTVSS

SEQ ID NO: 2030 - protein, 18 aa, Artificial Sequence
  source: /note="Description of Artificial Sequence: Synthetic peptide"
ARAKLEIAHYGGSPGFDY

SEQ ID NO: 2031 - protein, 107 aa, Artificial Sequence
  source: /note="Description of Artificial Sequence: Synthetic polypeptide"
SYELTQPPSVSVSPGQTASITCSGDKLGDKYTCWYQQKPGQSPVLVIYQDTQRPSGIPERFSGSNSGNTATLTISGTQAMDEADYYCQAWDSSTGVVFGGGTKVTVL

SEQ ID NO: 2032 - protein, 10 aa, Artificial Sequence
  source: /note="Description of Artificial Sequence: Synthetic peptide"
QAWDSSTGVV

SEQ ID NO: 2033 - protein, 123 aa, Artificial Sequence
  source: /note="Description of Artificial Sequence: Synthetic polypeptide"
EVQLVESGGGLVKPGGSLRLSCAASGFSFRSYSMNWVRQAPGKGLEWVSSISSSSSYIYYADSVKGRFTISRDNAKNSLYLQMNSLRAEDTAVYYCARMGLELPGLDYGMDVWGQGTTVTVSS

SEQ ID NO: 2034 - protein, 16 aa, Artificial Sequence
  source: /note="Description of Artificial Sequence: Synthetic peptide"
ARMGLELPGLDYGMDV

SEQ ID NO: 2035 - protein, 110 aa, Artificial Sequence
  source: /note="Description of Artificial Sequence: Synthetic polypeptide"
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSFNGPVFGGGTKLTVL

SEQ ID NO: 2036 - protein, 11 aa, Artificial Sequence
  source: /note="Description of Artificial Sequence: Synthetic peptide"
AAWDDSFNGPV

SEQ ID NO: 2037 - protein, 123 aa, Artificial Sequence
  source: /note="Description of Artificial Sequence: Synthetic polypeptide"
EVQLLESGGGLVQPGGSLRLSCAASGFTFSTYAMTWVRQAPGKGLEWVSAISGSGGRTYYADSVKGRFTISRDNSKNTLYLQMNSLRAEDTAVYYCAKVDYGEYVFSNAFDIWGQGTMVSVSS

SEQ ID NO: 2038 - protein, 16 aa, Artificial Sequence
  source: /note="Description of Artificial Sequence: Synthetic peptide"
AKVDYGEYVFSNAFDI

SEQ ID NO: 2039 - protein, 110 aa, Artificial Sequence
  source: /note="Description of Artificial Sequence: Synthetic polypeptide"
QSVLTQPASVSGSPGQSITISCTGTSSDVGSYNLVSWYQQHPDKAPKLMIYEVSKRPSGVSNRFSGSKSGNTASLTISGLQAEDEADYYCCSYAGTSTYVFGTGTKLTVL

SEQ ID NO: 2040 - protein, 10 aa, Artificial Sequence
  source: /note="Description of Artificial Sequence: Synthetic peptide"
CSYAGTSTYV

SEQ ID NO: 2041 - protein, 132 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVLSYEGSSTYYADSVKGRFTISRDNSKNTLYLQMNSLRAEDTAVYYCAKAGGRDYYDSSGYYLLDHYYGMDVWGQGTTVTVSS

SEQ ID NO: 2042 - protein, 25 aa, Artificial Sequence
  source: /note="Description of Artificial Sequence: Synthetic peptide"
AKAGGRDYYDSSGYYLLDHYYGMDV

SEQ ID NO: 2043 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKVTVL

SEQ ID NO: 2044 - protein, 12 aa, Artificial Sequence
  source: /note="Description of Artificial Sequence: Synthetic peptide"
QSYDSSLSGFYV

SEQ ID NO: 2045 - protein, 126 aa, Artificial Sequence; identical to SEQ ID NO: 167
  source: /note="Description of Artificial Sequence: Synthetic polypeptide"

SEQ ID NO: 2046 - protein, 19 aa, Artificial Sequence
  source: /note="Description of Artificial Sequence: Synthetic peptide"
ARESDCGSTSCYQVGWFDP

SEQ ID NO: 2047 - protein, 108 aa, Artificial Sequence; identical to SEQ ID NO: 110
  source: /note="Description of Artificial Sequence: Synthetic polypeptide"

SEQ ID NO: 2048 - protein, 10 aa, Artificial Sequence
  source: /note="Description of Artificial Sequence: Synthetic peptide"
QQSYSTPPWT

SEQ ID NO: 2049 - protein, 125 aa, Artificial Sequence
  source: /note="Description of Artificial Sequence: Synthetic polypeptide"
EVQLLESGGGLVQPGTSLRLSCAASGFTFSSYAMSWVRQAPGKGLEWVSAISSSGGSTYYADSVKGRFTISRDNSKNTLYLHMNSLRAEDTAVYYCATERIAVAGTRMYNWFDPWGQGTLVTVSS

SEQ ID NO: 2050 - protein, 18 aa, Artificial Sequence
  source: /note="Description of Artificial Sequence: Synthetic peptide"
ATERIAVAGTRMYNWFDP

SEQ ID NO: 2051 - protein, 108 aa, Artificial Sequence
  source: /note="Description of Artificial Sequence: Synthetic polypeptide"
DIQMTQSPSSLSASVGDRVTLTCRASQSISSYLNWYQQKPGKAPNLLIYAASSLQSGVPSRFSGSGSGTDFTLTISSLQPEDFATYYCQQSYSAPPWTFGQGTKVEIK

SEQ ID NO: 2052 - protein, 10 aa, Artificial Sequence
  source: /note="Description of Artificial Sequence: Synthetic peptide"
QQSYSAPPWT

SEQ ID NO: 2053 - protein, 122 aa, Artificial Sequence; identical to SEQ ID NO: 185
  source: /note="Description of Artificial Sequence: Synthetic polypeptide"

SEQ ID NO: 2054 - protein, 15 aa, Artificial Sequence
  source: /note="Description of Artificial Sequence: Synthetic peptide"
ASEEDYSNYVGWFDP

SEQ ID NO: 2055 - protein, 108 aa, Artificial Sequence; identical to SEQ ID NO: 110
  source: /note="Description of Artificial Sequence: Synthetic polypeptide"

SEQ ID NO: 2056 - protein, 10 aa, Artificial Sequence
  source: /note="Description of Artificial Sequence: Synthetic peptide"
QQSYSTPPWT

SEQ ID NO: 2057 - protein, 126 aa, Artificial Sequence; identical to SEQ ID NO: 167
  source: /note="Description of Artificial Sequence: Synthetic polypeptide"

SEQ ID NO: 2058 - protein, 19 aa, Artificial Sequence
  source: /note="Description of Artificial Sequence: Synthetic peptide"
ARESDCGSTSCYQVGWFDP

SEQ ID NO: 2059 - protein, 108 aa, Artificial Sequence; identical to SEQ ID NO: 110
  source: /note="Description of Artificial Sequence: Synthetic polypeptide"

SEQ ID NO: 2060 - protein, 10 aa, Artificial Sequence
  source: /note="Description of Artificial Sequence: Synthetic peptide"
QQSYSTPPWT

SEQ ID NO: 2061 - protein, 126 aa, Artificial Sequence; identical to SEQ ID NO: 167
  source: /note="Description of Artificial Sequence: Synthetic polypeptide"

SEQ ID NO: 2062 - protein, 19 aa, Artificial Sequence
  source: /note="Description of Artificial Sequence: Synthetic peptide"
ARESDCGSTSCYQVGWFDP

SEQ ID NO: 2063 - protein, 108 aa, Artificial Sequence; identical to SEQ ID NO: 110
  source: /note="Description of Artificial Sequence: Synthetic polypeptide"

SEQ ID NO: 2064 - protein, 10 aa, Artificial Sequence
  source: /note="Description of Artificial Sequence: Synthetic peptide"
QQSYSTPPWT

SEQ ID NO: 2065 - protein, 117 aa, Artificial Sequence; identical to SEQ ID NO: 165
  source: /note="Description of Artificial Sequence: Synthetic polypeptide"

SEQ ID NO: 2066 - protein, 11 aa, Artificial Sequence
  source: /note="Description of Artificial Sequence: Synthetic peptide"
ARDTLGRGGDY

SEQ ID NO: 2067 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPRSFGQGTKLEIK

SEQ ID NO: 2068 - protein, 9 aa, Artificial Sequence
  source: /note="Description of Artificial Sequence: Synthetic peptide"
QQYDNLPRS

SEQ ID NO: 2069 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSLIYSGGSTYYADSVKGRFTISRDNSKNTLYLQMNSLRAEDTAVYYCARDTFGRGGDYWGQGTLVTVSS

SEQ ID NO: 2070 - protein, 11 aa, Artificial Sequence
  source: /note="Description of Artificial Sequence: Synthetic peptide"
ARDTFGRGGDY

SEQ ID NO: 2071 - protein, 107 aa, Artificial Sequence; identical to SEQ ID NO: 2067
  source: /note="Description of Artificial Sequence: Synthetic polypeptide"

SEQ ID NO: 2072 - protein, 9 aa, Artificial Sequence
  source: /note="Description of Artificial Sequence: Synthetic peptide"
QQYDNLPRS

SEQ ID NO: 2073 - protein, 117 aa, Artificial Sequence
  source: /note="Description of Artificial Sequence: Synthetic polypeptide"
EVQLVESGGGLVQPGGSLRLSCAASGFTVSSNYMSWVRQAPGKGLEWVSLIYSGGSTYYADSVKGRFTISRDNSKNTLYLQMNTLRAEDTAVYYCARDTLGRGGDYWGQGTLVTVSS

SEQ ID NO: 2074 - protein, 11 aa, Artificial Sequence
  source: /note="Description of Artificial Sequence: Synthetic peptide"
ARDTLGRGGDY

SEQ ID NO: 2075 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKVLIYDASNLETGVPSRFSGSGSGTDFTFTISSLQPEDIATYFCQQYDNLPRSFGQGTKLEIK

SEQ ID NO: 2076 - protein, 9 aa, Artificial Sequence
  source: /note="Description of Artificial Sequence: Synthetic peptide"
QQYDNLPRS

SEQ ID NO: 2077 - protein, 117 aa, Artificial Sequence; identical to SEQ ID NO: 2073
  source: /note="Description of Artificial Sequence: Synthetic polypeptide"

SEQ ID NO: 2078 - protein, 11 aa, Artificial Sequence
  source: /note="Description of Artificial Sequence: Synthetic peptide"
ARDTLGRGGDY

SEQ ID NO: 2079 - protein, 107 aa, Artificial Sequence; identical to SEQ ID NO: 2075
  source: /note="Description of Artificial Sequence: Synthetic polypeptide"

SEQ ID NO: 2080 - protein, 9 aa, Artificial Sequence
  source: /note="Description of Artificial Sequence: Synthetic peptide"
QQYDNLPRS

SEQ ID NO: 2081 - protein, 121 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSDSIGYADSVKGRFTISRDNAKNSLYLQMNSLTAEDTALYYCAKGVEYSSSSNFDYWGQGTLVTVSS

SEQ ID NO: 2082 - protein, 14 aa, Artificial Sequence
  source: /note="Description of Artificial Sequence: Synthetic peptide"
AKGVEYSSSSNFDY

SEQ ID NO: 2083 - protein, 106 aa, Artificial Sequence
  source: /note="Description of Artificial Sequence: Synthetic polypeptide"
DIQMTQSPSSVSASVGDRVTITCRASQGISSWLAWYQQKPGKAPKLLIYTASGLQSGVPSRFSGSGSETDFTLTISSLQPEDFATYYCQQTNSFPLTFGGGTKVEI

SEQ ID NO: 2084 - protein, 9 aa, Artificial Sequence
  source: /note="Description of Artificial Sequence: Synthetic peptide"
QQTNSFPLT

SEQ ID NO: 2085 - protein, 121 aa, Artificial Sequence; identical to SEQ ID NO: 163
  source: /note="Description of Artificial Sequence: Synthetic polypeptide"

SEQ ID NO: 2086 - protein, 14 aa, Artificial Sequence
  source: /note="Description of Artificial Sequence: Synthetic peptide"
VKGVEYSSSSNFDY

SEQ ID NO: 2087 - protein, 106 aa, Artificial Sequence; identical to SEQ ID NO: 2083
  source: /note="Description of Artificial Sequence: Synthetic polypeptide"

SEQ ID NO: 2088 - protein, 9 aa, Artificial Sequence
  source: /note="Description of Artificial Sequence: Synthetic peptide"
QQTNSFPLT

SEQ ID NO: 2089 - protein, 121 aa, Artificial Sequence; identical to SEQ ID NO: 163
  source: /note="Description of Artificial Sequence: Synthetic polypeptide"

SEQ ID NO: 2090 - protein, 14 aa, Artificial Sequence
  source: /note="Description of Artificial Sequence: Synthetic peptide"
VKGVEYSSSSNFDY

SEQ ID NO: 2091 - protein, 107 aa, Artificial Sequence
  source: /note="Description of Artificial Sequence: Synthetic polypeptide"
DIQMTQSPSSVSASVGDRVTITCRASQGISSWLAWYQQKPGKAPKLLIYVESSLQSGVPSRFSGSGSGTDFTLTISSLQPEDFATYYCQQANSFPLTFGGGTKVEIK

SEQ ID NO: 2092 - protein, 9 aa, Artificial Sequence
  source: /note="Description of Artificial Sequence: Synthetic peptide"
QQANSFPLT

SEQ ID NO: 2093 - protein, 120 aa, Artificial Sequence; identical to SEQ ID NO: 181
  source: /note="Description of Artificial Sequence: Synthetic polypeptide"

SEQ ID NO: 2094 - protein, 13 aa, Artificial Sequence
  source: /note="Description of Artificial Sequence: Synthetic peptide"
ARERYFDLGGMDV

SEQ ID NO: 2095 - protein, 110 aa, Artificial Sequence
  source: /note="Description of Artificial Sequence: Synthetic polypeptide"
QSALTQPASVSGSPGQSITISCTGTSSDVGSYNLVSWYQQHPGKAPKLMIYEDSKRPSGVSNRFSGSKSGNTASLTISGLQAEDEADYYCCSYAGSSTRLFGGGTKLTVL

SEQ ID NO: 2096 - protein, 10 aa, Artificial Sequence
  source: /note="Description of Artificial Sequence: Synthetic peptide"
CSYAGSSTRL

SEQ ID NO: 2097 - protein, 120 aa, Artificial Sequence
  source: /note="Description of Artificial Sequence: Synthetic polypeptide"
QVQLVQSGAEVKKPGASVKVSCKASGYTVTGYYIHWVRQAPGQGLEWMGWISPNSGGTNYAQKFQGWVTMTRDMSITTAYMELSRLRSDDTAVYYCAREPYFDLGGMDVWGQGTTVTVSS

SEQ ID NO: 2098 - protein, 13 aa, Artificial Sequence
  source: /note="Description of Artificial Sequence: Synthetic peptide"
AREPYFDLGGMDV

SEQ ID NO: 2099 - protein, 110 aa, Artificial Sequence
  source: /note="Description of Artificial Sequence: Synthetic polypeptide"
  MOD_RES (3)..(3): Any amino acid
QSXLTQPASVSGSPGQSITISCTGTSSDVGSYNLVSWYQQHPGKAPKLMIYEGSKRPSGVSNRFSGSKSGNTASLTISGLQAEDEADYYCCSYAGSSTRVFGGGTKLTVL

SEQ ID NO: 2100 - protein, 10 aa, Artificial Sequence
  source: /note="Description of Artificial Sequence: Synthetic peptide"
CSYAGSSTRV

SEQ ID NO: 2101 - protein, 119 aa, Artificial Sequence
  source: /note="Description of Artificial Sequence: Synthetic polypeptide"
QVQLVQSGAEVKKSGASVKVSCKASGYTFTSYDINWVRQATGQGLEWMGWMNPNSGNTGYAQKFQGRVTMTRNTSISTAYMDLSSLRSEDTAVYYCARGFSLTWYFDLWGRGTLVTVSS

SEQ ID NO: 2102 - protein, 12 aa, Artificial Sequence
  source: /note="Description of Artificial Sequence: Synthetic peptide"
ARGFSLTWYFDL

SEQ ID NO: 2103 - protein, 110 aa, Artificial Sequence
  source: /note="Description of Artificial Sequence: Synthetic polypeptide"
  MOD_RES (3)..(3): Any amino acid
SYXLTQPPSVSVAPGKTARITCGGNNIGSKSVHWYQQKPGHAPVLVVYDDSDRPSGIPERFSGSNSGNTATLTISRVEAGDEADYYCQVWDSTGGHPDVVFGGGTKLTVL

SEQ ID NO: 2104 - protein, 13 aa, Artificial Sequence
  source: /note="Description of Artificial Sequence: Synthetic peptide"
QVWDSTGGHPDVV

SEQ ID NO: 2105 - protein, 119 aa, Artificial Sequence
  source: /note="Description of Artificial Sequence: Synthetic polypeptide"
QVQLVQSGAEVKKPGASVKVSCKASGYTFTSYDVNWVRQATGQGLEWMGWMNPNSGSAGYAQKFQGRVTMTRNTSISTAYMELSSLRSEDTAVYYCARGFSLTWYFDLWGRGTLVTVSS

SEQ ID NO: 2106 - protein, 12 aa, Artificial Sequence
  source: /note="Description of Artificial Sequence: Synthetic peptide"
ARGFSLTWYFDL

SEQ ID NO: 2107 - protein, 110 aa, Artificial Sequence
  source: /note="Description of Artificial Sequence: Synthetic polypeptide"
  MOD_RES (3)..(3): Any amino acid
SYXLTQPPSVSVAPGKTARITCGGNNIGSKSVHWYQQKPGQAPVLVVYDDSDRPSGIPERFSGSNSGNTATLTISRVEAGDEADYYCQVWDSTSDHPDVVFGGGTKLTVL

SEQ ID NO: 2108 - protein, 13 aa, Artificial Sequence
  source: /note="Description of Artificial Sequence: Synthetic peptide"
QVWDSTSDHPDVV

SEQ ID NO: 2109 - protein, 120 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSFISSRSSYIYYADSVKGRFTISRDNAKNSLYLQMNSLRAEDTAVYYCARVQVGARGWVDYWGQGTLVTVSS

SEQ ID NO: 2110 - protein, 13 aa, Artificial Sequence
  source: /note="Description of Artificial Sequence: Synthetic peptide"
ARVQVGARGWVDY

SEQ ID NO: 2111 - protein, 110 aa, Artificial Sequence
  source: /note="Description of Artificial Sequence: Synthetic polypeptide"
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSINWVFGGGTKLTVL

SEQ ID NO: 2112 - protein, 9 aa, Artificial Sequence
  source: /note="Description of Artificial Sequence: Synthetic peptide"
QSYDSINWV

SEQ ID NO: 2113 - protein, 120 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQVGARGWVDYWGQGTLVTVSS

SEQ ID NO: 2114 - protein, 13 aa, Artificial Sequence
  source: /note="Description of Artificial Sequence: Synthetic peptide"
ARVQVGARGWVDY

SEQ ID NO: 2115 - protein, 110 aa, Artificial Sequence
  source: /note="Description of Artificial Sequence: Synthetic polypeptide"
NFMLTQPHSVSESPGKTVTISCTRSSGSIASNYVQWYQQRPGSAPTTVIYEDNERPSGVPDRFSGSIDSSSNSASLTISGLKTEDEADYYCQSYDRINWVFGGGTKLTVL

SEQ ID NO: 2116 - protein, 9 aa, Artificial Sequence
  source: /note="Description of Artificial Sequence: Synthetic peptide"
QSYDRINWV

SEQ ID NO: 2117 - protein, 121 aa, Artificial Sequence; identical to SEQ ID NO: 171
  source: /note="Description of Artificial Sequence: Synthetic polypeptide"

SEQ ID NO: 2118 - protein, 14 aa, Artificial Sequence
  source: /note="Description of Artificial Sequence: Synthetic peptide"
AKEPIGQPLLWWDY

SEQ ID NO: 2119 - protein, 107 aa, Artificial Sequence; identical to SEQ ID NO: 172
  source: /note="Description of Artificial Sequence: Synthetic polypeptide"

SEQ ID NO: 2120 - protein, 9 aa, Artificial Sequence
  source: /note="Description of Artificial Sequence: Synthetic peptide"
QQRSNWPRG

SEQ ID NO: 2121 - protein, 121 aa, Artificial Sequence; identical to SEQ ID NO: 171
  source: /note="Description of Artificial Sequence: Synthetic polypeptide"

SEQ ID NO: 2122 - protein, 14 aa, Artificial Sequence
  source: /note="Description of Artificial Sequence: Synthetic peptide"
AKEPIGQPLLWWDY

SEQ ID NO: 2123 - protein, 107 aa, Artificial Sequence; identical to SEQ ID NO: 172
  source: /note="Description of Artificial Sequence: Synthetic polypeptide"

SEQ ID NO: 2124 - protein, 9 aa, Artificial Sequence
  source: /note="Description of Artificial Sequence: Synthetic peptide"
QQRSNWPRG

SEQ ID NO: 2125 - protein, 121 aa, Artificial Sequence
  source: /note="Description of Artificial Sequence: Synthetic polypeptide"
EVQLVESGGGLVQPGRSLRLSCAASGFTFDDYAMHWVRQVPGKGLEWVSGISWNSASIGYADSVKGRFTISRDNAKNSLYLQMNSLRPEDMAFYYCAKGSSSGWTRPLDYWGQGTLVTVSS

SEQ ID NO: 2126 - protein, 14 aa, Artificial Sequence
  source: /note="Description of Artificial Sequence: Synthetic peptide"
AKGSSSGWTRPLDY

SEQ ID NO: 2127 - protein, 108 aa, Artificial Sequence
  source: /note="Description of Artificial Sequence: Synthetic polypeptide"
  MOD_RES (3)..(3): Any amino acid
SYXLTQPPSVSVAPGKTARITCGGNNIGSKSVHWYQQKPGQAPVLVVYDDSDRPSGIPERFSGSNSGNTATLTISRVEAGDEADYYCQVWDSSSDPVVFGGGTKLTVL

SEQ ID NO: 2128 - protein, 11 aa, Artificial Sequence
  source: /note="Description of Artificial Sequence: Synthetic peptide"
QVWDSSSDPVV

SEQ ID NO: 2129 - protein, 121 aa, Artificial Sequence; identical to SEQ ID NO: 2125
  source: /note="Description of Artificial Sequence: Synthetic polypeptide"

SEQ ID NO: 2130 - protein, 14 aa, Artificial Sequence
  source: /note="Description of Artificial Sequence: Synthetic peptide"
AKGSSSGWTRPLDY

SEQ ID NO: 2131 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPVVFGGGTKLTVL

SEQ ID NO: 2132 - protein, 11 aa, Artificial Sequence
  source: /note="Description of Artificial Sequence: Synthetic peptide"
QVWDSSSDPVV

SEQ ID NO: 2133 - protein, 129 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRPRDYYDRSGYYYVPGYFDYWGQGTLVTVSS

SEQ ID NO: 2134 - protein, 22 aa, Artificial Sequence
  source: /note="Description of Artificial Sequence: Synthetic peptide"
ARRPRDYYDRSGYYYVPGYFDY

SEQ ID NO: 2135 - protein, 107 aa, Artificial Sequence; identical to SEQ ID NO: 118
  source: /note="Description of Artificial Sequence: Synthetic polypeptide"

SEQ ID NO: 2136 - protein, 9 aa, Artificial Sequence
  source: /note="Description of Artificial Sequence: Synthetic peptide"
QQYDNLPLT

SEQ ID NO: 2137 - protein, 125 aa, Artificial Sequence
  source: /note="Description of Artificial Sequence: Synthetic polypeptide"
QVQLVQSGAEVKKPGASVKVSCKASGSTFTGYYMHWVRQAPGQGLEWMGWINPNSGGTNYAQKFQGWVTMTRDTSISTAYMELSRLRSDDTAVYYCAREKVATMFALPPYGMDVWGQGTTVTVSS

SEQ ID NO: 2138 - protein, 18 aa, Artificial Sequence
  source: /note="Description of Artificial Sequence: Synthetic peptide"
AREKVATMFALPPYGMDV

SEQ ID NO: 2139 - protein, 108 aa, Artificial Sequence
  source: /note="Description of Artificial Sequence: Synthetic polypeptide"
EIVLTQSPATLSLSPGERATLSCRASQSVSSYLAWYQQKPGQTPRLLIYDASNRATGIPARFSGSGSGTDFTLTISSLEPEDFAVYYCQQRSNWPPIAFGQGTRLEIK

SEQ ID NO: 2140 - protein, 10 aa, Artificial Sequence
  source: /note="Description of Artificial Sequence: Synthetic peptide"
QQRSNWPPIA

SEQ ID NO: 2141 - protein, 124 aa, Artificial Sequence
  source: /note="Description of Artificial Sequence: Synthetic polypeptide"
QVQLVQSGAEVKKPGASVKVSCKASGYTFTYYYMHWVRQAPGQGLEWMGIINPSGGSTSYAQKFQGRVTMTRDTSTSTVYMELSSLRSEDTAVYYCARPLLPGETGSLNRLDYWGQGTLVTVSS

SEQ ID NO: 2142 - protein, 17 aa, Artificial Sequence
  source: /note="Description of Artificial Sequence: Synthetic peptide"
ARPLLPGETGSLNRLDY

SEQ ID NO: 2143 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 2144 - protein, 9 aa, Artificial Sequence
  source: /note="Description of Artificial Sequence: Synthetic peptide"
QQSYSTLWT

SEQ ID NO: 2145 - protein, 124 aa, Artificial Sequence; identical to SEQ ID NO: 169
  source: /note="Description of Artificial Sequence: Synthetic polypeptide"

SEQ ID NO: 2146 - protein, 17 aa, Artificial Sequence
  source: /note="Description of Artificial Sequence: Synthetic peptide"
ARGPERGIVGATDYFDY

SEQ ID NO: 2147 - protein, 108 aa, Artificial Sequence; identical to SEQ ID NO: 170
  source: /note="Description of Artificial Sequence: Synthetic polypeptide"

SEQ ID NO: 2148 - protein, 9 aa, Artificial Sequence
  source: /note="Description of Artificial Sequence: Synthetic peptide"
QQYVSSPWT

SEQ ID NO: 2149 - protein, 118 aa, Artificial Sequence
  source: /note="Description of Artificial Sequence: Synthetic polypeptide"
QVQLVQSGAEVKKPGSSVKVSCKASGGTFSSNAISWVRQAPGQGLEWMGGITPIFGTVNYAQKFQGRVTITADESTSTAYMELSSLRSEDTAVYYCASEWEIFGFDYWGQGTLVTVSS

SEQ ID NO: 2150 - protein, 11 aa, Artificial Sequence
  source: /note="Description of Artificial Sequence: Synthetic peptide"
ASEWEIFGFDY

SEQ ID NO: 2151 - protein, 107 aa, Artificial Sequence
  source: /note="Description of Artificial Sequence: Synthetic polypeptide"
DIQMTQSPSSLSASVGDRVTITCRASQSISRYLNWYQQKSGKAPKLLIYAASSLQSGVPSRFSGSGSGTDFTLTISSLQPEDFATYYCQQSYSTPWTFGQGTKVEIK

SEQ ID NO: 2152 - protein, 9 aa, Artificial Sequence
  source: /note="Description of Artificial Sequence: Synthetic peptide"
QQSYSTPWT

SEQ ID NO: 2153 - protein, 126 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTTNHAQKFQGRVTITADESTSTAYMELSSLRSEDTAVYYCTSGQGAGVNRGVVITTLGYWGQGTLVTVSS

SEQ ID NO: 2154 - protein, 19 aa, Artificial Sequence
  source: /note="Description of Artificial Sequence: Synthetic peptide"
TSGQGAGVNRGVVITTLGY

SEQ ID NO: 2155 - protein, 113 aa, Artificial Sequence
  source: /note="Description of Artificial Sequence: Synthetic polypeptide"
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPCSFGQGTKLEIK

SEQ ID NO: 2156 - protein, 9 aa, Artificial Sequence
  source: /note="Description of Artificial Sequence: Synthetic peptide"
QQYYSTPCS

SEQ ID NO: 2157 - protein, 121 aa, Artificial Sequence
  source: /note="Description of Artificial Sequence: Synthetic polypeptide"
QVQLVQSGAEVKKPGSSVKVSCKASGGTISSYAISWVRQAPGQGLEWMGGIIPIFGTTNYAQKFQGRVTITADESTSTAYMELSSLRSEDTALYYCARDDGQQLWSYFDYWGQGTLVTVSS

SEQ ID NO: 2158 - protein, 14 aa, Artificial Sequence
  source: /note="Description of Artificial Sequence: Synthetic peptide"
ARDDGQQLWSYFDY

SEQ ID NO: 2159 - protein, 114 aa, Artificial Sequence
  source: /note="Description of Artificial Sequence: Synthetic polypeptide"
DIVMTQSPDSLAVSLGERATINCKSSQSVLYSSNNKSYLAWYQQKPGQPPKLLIYWASTRESGVPDRFSGSGSGTDFTLTISSLQAEDVAVYYCQQYYSTLPLTFGGGTKVEIK

SEQ ID NO: 2160 - protein, 10 aa, Artificial Sequence
  source: /note="Description of Artificial Sequence: Synthetic peptide"
QQYYSTLPLT

SEQ ID NO: 2161 - protein, 118 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLPPRRFDIWGQGTMVTVSS

SEQ ID NO: 2162 - protein, 11 aa, Artificial Sequence
  source: /note="Description of Artificial Sequence: Synthetic peptide"
ARDLPPRRFDI

SEQ ID NO: 2163 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQFDNLPITFGQGTRLEIK

SEQ ID NO: 2164 - protein, 9 aa, Artificial Sequence
  source: /note="Description of Artificial Sequence: Synthetic peptide"
QQFDNLPIT

SEQ ID NO: 2165 - protein, 122 aa, Artificial Sequence
  source: /note="Description of Artificial Sequence: Synthetic polypeptide"
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGDSGSYLGVWYFDLWGRGTLVTVSS

SEQ ID NO: 2166 - protein, 16 aa, Artificial Sequence
  source: /note="Description of Artificial Sequence: Synthetic peptide"
ARGDSGSYLGVWYFDL

SEQ ID NO: 2167 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSSPPITFGPGTKVDIK

SEQ ID NO: 2168 - protein, 10 aa, Artificial Sequence
  source: /note="Description of Artificial Sequence: Synthetic peptide"
QQSYSSPPIT

SEQ ID NO: 2169 - protein, 122 aa, Artificial Sequence; identical to SEQ ID NO: 187
  source: /note="Description of Artificial Sequence: Synthetic polypeptide"

SEQ ID NO: 2170 - protein, 16 aa, Artificial Sequence
  source: /note="Description of Artificial Sequence: Synthetic peptide"
ARDRGSSGWYGWYFDL

SEQ ID NO: 2171 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYVASSLQSGVPSRFSGSGSGTDFTLTISSLQPEDFATYYCQQSYSTPPITFGQGTRLEIK

SEQ ID NO: 2172 - protein, 10 aa, Artificial Sequence
  source: /note="Description of Artificial Sequence: Synthetic peptide"
QQSYSTPPIT

SEQ ID NO: 2173 - protein, 121 aa, Artificial Sequence
  source: /note="Description of Artificial Sequence: Synthetic polypeptide"
EVQLVESGGGLVQPGGSLRLSCAASGFIFSSYDMHWVRQATGKGLEWVSTIGTAGDTYYPDSVKGRFTISRENAKNSLYLQMNSLRAGDTAVYYCARGDYNILTGYYFDYWGQGTLVTVSS

SEQ ID NO: 2174 - protein, 15 aa, Artificial Sequence
  source: /note="Description of Artificial Sequence: Synthetic peptide"
ARGDYNILTGYYFDY

SEQ ID NO: 2175 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPNLLIYAASSLQSGVPSRFSGSGSGTDFTLTISSLQPEDFATYYCQQSYNTPQVTFGGGTKVESK

SEQ ID NO: 2176 - protein, 10 aa, Artificial Sequence
  source: /note="Description of Artificial Sequence: Synthetic peptide"
QQSYNTPQVT

SEQ ID NO: 2177 - protein, 118 aa, Artificial Sequence
  source: /note="Description of Artificial Sequence: Synthetic polypeptide"
EVQLVESGGGLVQPGGSLRLSCAASGFTFSSYDMHWVRQATGKGLQWVSAIGTAGDTYYPDSVKGRFTISRENAKNSLYLQMNSLRAGDTAVYYCARDRDSSWSFDYWGQGTLVTVSS

SEQ ID NO: 2178 - protein, 12 aa, Artificial Sequence
  source: /note="Description of Artificial Sequence: Synthetic peptide"
ARDRDSSWSFDY

SEQ ID NO: 2179 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGGGSGADFTLTISSLQPEDFATYYCQQSYSTPPITFGQGTRLEIK

SEQ ID NO: 2180 - protein, 10 aa, Artificial Sequence
  source: /note="Description of Artificial Sequence: Synthetic peptide"
QQSYSTPPIT

SEQ ID NO: 2181 - protein, 123 aa, Artificial Sequence
  source: /note="Description of Artificial Sequence: Synthetic polypeptide"
EVQLVESGGGLVQPGGSLRLSCAASGFTFSSYDMHWVRQASGKGLEWVSAIGTSGDTYYPGSVKGRFTISRENAKNSLYLQMNSLRAGDTAVYYCARGTFFYGSGSYNWFDPWGQGTLVTVSS

SEQ ID NO: 2182 - protein, 17 aa, Artificial Sequence
  source: /note="Description of Artificial Sequence: Synthetic peptide"
ARGTFFYGSGSYNWFDP

SEQ ID NO: 2183 - protein, 108 aa, Artificial Sequence; identical to SEQ ID NO: 110
  source: /note="Description of Artificial Sequence: Synthetic polypeptide"

SEQ ID NO: 2184 - protein, 10 aa, Artificial Sequence
  source: /note="Description of Artificial Sequence: Synthetic peptide"
QQSYSTPPWT

SEQ ID NO: 2185 - protein, 122 aa, Artificial Sequence
  source: /note="Description of Artificial Sequence: Synthetic polypeptide"
EVQLVESGGGLVKPGGSLRVSCAASGFSFSYAWMSWVRQAPGKGLEWVGRIKSKTDGGTTDCAAPVKGRFTISRDDSKNTLYLQMNSLKTEDTAVYYCTTLSDYGDLSSVYWGQGTLVTVSS

SEQ ID NO: 2186 - protein, 13 aa, Artificial Sequence
  source: /note="Description of Artificial Sequence: Synthetic peptide"
TTLSDYGDLSSVY

SEQ ID NO: 2187 - protein, 107 aa, Artificial Sequence [sequence omitted]

SEQ ID NO: 2188 - protein, 9 aa, Artificial Sequence
  source: /note="Description of Artificial Sequence: Synthetic peptide"
QQSYSTPLT

SEQ ID NO: 2189 - protein, 117 aa, Artificial Sequence
  source: /note="Description of Artificial Sequence: Synthetic polypeptide"
EVQLVESGGGLVKPGGSLRLSCAASGFTVRSYSMNWVRQAPGKGLEWVSCMTSSGSYLYYADSVKGRFTISRDNAKNSLYLQMNSLRDEDTAVYYCAKEEYYGMDVWGQGATVTVSS

SEQ ID NO: 2190 - protein, 10 aa, Artificial Sequence
  source: /note="Description of Artificial Sequence: Synthetic peptide"
AKEEYYGMDV

SEQ ID NO: 2191 - protein, 107 aa, Artificial Sequence
  source: /note="Description of Artificial Sequence: Synthetic polypeptide"
DIQMTQSPSSLSASVGDRVTITCRASQDISSWLAWYQQKPGKAPKLLIYAASNLQSGVPSRFSGSGSGTHFTLTISSLQPEDFVTYYCQQANRFPITFGQGTRLEIK

SEQ ID NO: 2192 - protein, 9 aa, Artificial Sequence
  source: /note="Description of Artificial Sequence: Synthetic peptide"
QQANRFPIT

SEQ ID NO: 2193 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYFCAKQLYYYGSGSYVFDYWGQGTLVTVSS

SEQ ID NO: 2194 - protein, 16 aa, Artificial Sequence
  source: /note="Description of Artificial Sequence: Synthetic peptide"
AKQLYYYGSGSYVFDY

SEQ ID NO: 2195 - protein, 107 aa, Artificial Sequence
  source: /note="Description of Artificial Sequence: Synthetic polypeptide"
DIQMTQSPSSLSASVGDRVTITCQASQDIRNFLNWYQQKPGKAPKLLIYDASNLETGVPSRFSGSGSGTDFTFTISSLQPEDIATYYCQQYDNLPLTFGGGTKVEIK

SEQ ID NO: 2196 - protein, 9 aa, Artificial Sequence
  source: /note="Description of Artificial Sequence: Synthetic peptide"
QQYDNLPLT

SEQ ID NO: 2197 - protein, 128 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDTPGGDDILTGWGLYGMDVWGQGTTVTVSS

SEQ ID NO: 2198 - protein, 21 aa, Artificial Sequence
  source: /note="Description of Artificial Sequence: Synthetic peptide"
AKDTPGGDDILTGWGLYGMDV

SEQ ID NO: 2199 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAAFSLQSGVPSRFSGSGSGTDFTLTISSLQPEDFATYYCQQSYSTPWTFGQGTKVEIK

SEQ ID NO: 2200 - protein, 9 aa, Artificial Sequence
  source: /note="Description of Artificial Sequence: Synthetic peptide"
QQSYSTPWT

SEQ ID NO: 2201 - protein, 120 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVIWYDGSNKHYADSVKGRFTISRDNSKNTLYLQMNSLRAEDTAEYYCARDMGTLVTHFDYWGQGTLVTVSS

SEQ ID NO: 2202 - protein, 13 aa, Artificial Sequence
  source: /note="Description of Artificial Sequence: Synthetic peptide"
ARDMGTLVTHFDY

SEQ ID NO: 2203 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASNLQSGVPSRFSGSGSGTDFTLTISSLQPEDFATYYCQQSYSSPPWTFGQGTKVEIK

SEQ ID NO: 2204 - protein, 10 aa, Artificial Sequence
  source: /note="Description of Artificial Sequence: Synthetic peptide"
QQSYSSPPWT

SEQ ID NO: 2205 - protein, 120 aa, Artificial Sequence; identical to SEQ ID NO: 183
  source: /note="Description of Artificial Sequence: Synthetic polypeptide"

SEQ ID NO: 2206 - protein, 13 aa, Artificial Sequence
  source: /note="Description of Artificial Sequence: Synthetic peptide"
ARDVGRVTTWFDP

SEQ ID NO: 2207 - protein, 108 aa, Artificial Sequence
  source: /note="Description of Artificial Sequence: Synthetic polypeptide"
DIQMTQSPSSLSASVGDRVTITCRASQSISSYLTWYQQKPGKAPKLLIYAASSLQSGVPSRFSGSGSGTDFTLTISSLQPEDFATYYCQQSYSTPPWTFGQGTKVEIK

SEQ ID NO: 2208 - protein, 10 aa, Artificial Sequence
  source: /note="Description of Artificial Sequence: Synthetic peptide"
QQSYSTPPWT

SEQ ID NO: 2209 - protein, 123 aa, Artificial Sequence
  source: /note="Description of Artificial Sequence: Synthetic polypeptide"
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARASGLRSYYYYGMDVWGQGTTVTVSS

SEQ ID NO: 2210 - protein, 16 aa, Artificial Sequence
  source: /note="Description of Artificial Sequence: Synthetic peptide"
ARASGLRSYYYYGMDV

SEQ ID NO: 2211 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPATFGQGTKVEIK

SEQ ID NO: 2212 - protein, 9 aa, Artificial Sequence
  source: /note="Description of Artificial Sequence: Synthetic peptide"
QQSYSTPAT

SEQ ID NO: 2213 - protein, 123 aa, Artificial Sequence
  source: /note="Description of Artificial Sequence: Synthetic polypeptide"
EVQLVESGGGLVQPGGSLRLSCAASGFTFTNYNMNWVRQAPGKGLEWVSYISSSSSTIYYADSVKGRFTISRDNAKNSLYLQMNSLRDEDTAVYYCARVVGSGSYYYYGMDVWGQGTTVTVSS

SEQ ID NO: 2214 - protein, 16 aa, Artificial Sequence
  source: /note="Description of Artificial Sequence: Synthetic peptide"
ARVVGSGSYYYYGMDV

SEQ ID NO: 2215 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYGASSLQSGVPSRFSGSGSGTDFTLTISSLQPEDFATYYCQQSYSTPATFGQGTKLEIK

SEQ ID NO: 2216 - protein, 9 aa, Artificial Sequence
  source: /note="Description of Artificial Sequence: Synthetic peptide"
QQSYSTPAT

SEQ ID NO: 2217 - protein, 129 aa, Artificial Sequence
  source: /note="Description of Artificial Sequence: Synthetic polypeptide"
EVQLVESGGGLVQPGRSLRLSCTASGFTFGDYAMNWFRQAPGKGLEWVGFIRSKAYGGTTEYAASVRGRFTISRDDSESIAYLQMNSLKTEDTAVYYCTRDLSYYYDSSGRGSHLFDYWGQGTLVTVSS

SEQ ID NO: 2218 - protein, 20 aa, Artificial Sequence
  source: /note="Description of Artificial Sequence: Synthetic peptide"
TRDLSYYYDSSGRGSHLFDY

SEQ ID NO: 2219 - protein, 106 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK

SEQ ID NO: 2220 - protein, 8 aa, Artificial Sequence
  source: /note="Description of Artificial Sequence: Synthetic peptide"
QQYNNWWT

SEQ ID NO: 2221 - protein, 129 aa, Artificial Sequence; identical to SEQ ID NO: 2217
  source: /note="Description of Artificial Sequence: Synthetic polypeptide"

SEQ ID NO: 2222 - protein, 20 aa, Artificial Sequence
  source: /note="Description of Artificial Sequence: Synthetic peptide"
TRDLSYYYDSSGRGSHLFDY

SEQ ID NO: 2223 - protein, 106 aa, Artificial Sequence; identical to SEQ ID NO: 2219
  source: /note="Description of Artificial Sequence: Synthetic polypeptide"

SEQ ID NO: 2224 - protein, 8 aa, Artificial Sequence
  source: /note="Description of Artificial Sequence: Synthetic peptide"
QQYNNWWT

SEQ ID NO: 2225 - protein, 117 aa, Artificial Sequence; identical to SEQ ID NO: 177
  source: /note="Description of Artificial Sequence: Synthetic polypeptide"

SEQ ID NO: 2226 - protein, 11 aa, Artificial Sequence
  source: /note="Description of Artificial Sequence: Synthetic peptide"
ARDLMAYGMDV

SEQ ID NO: 2227 - protein, 108 aa, Artificial Sequence; identical to SEQ ID NO: 178
  source: /note="Description of Artificial Sequence: Synthetic polypeptide"

SEQ ID NO: 2228 - protein, 10 aa, Artificial Sequence
  source: /note="Description of Artificial Sequence: Synthetic peptide"
QQLNSYPQGT

SEQ ID NO: 2229 - protein, 117 aa, Artificial Sequence
  source: /note="Description of Artificial Sequence: Synthetic polypeptide"
EVQLVESGGGLIQPGGSLRLSCAASGVIVSSNYMSWVRQAPGKGLEWVSVIYSGGSTYYADSVKGRFTISRDNSKNTLYLQMNSLRAEDTAVYYCARDGGHYGMDVWGQGTTVTVSS

SEQ ID NO: 2230 - protein, 11 aa, Artificial Sequence
  source: /note="Description of Artificial Sequence: Synthetic peptide"
ARDGGHYGMDV

SEQ ID NO: 2231 - protein, 107 aa, Artificial Sequence; identical to SEQ ID NO: 90
  source: /note="Description of Artificial Sequence: Synthetic polypeptide"

SEQ ID NO: 2232 - protein, 9 aa, Artificial Sequence
  source: /note="Description of Artificial Sequence: Synthetic peptide"
QQLNSYPPA

SEQ ID NO: 2233 - protein, 115 aa, Artificial Sequence
  source: /note="Description of Artificial Sequence: Synthetic polypeptide"
EVQLVESGGGLIQPGGSLRLSCAASGLTVSRNYMNWVRQAPGKGLEWVSVMYSGGSTFYADSVKGRFTISRDNSKNTLYLQMNSLRAEDTAVYYCARESYGMDVWGQGTTVTVSS

SEQ ID NO: 2234 - protein, 9 aa, Artificial Sequence
  source: /note="Description of Artificial Sequence: Synthetic peptide"
ARESYGMDV

SEQ ID NO: 2235 - protein, 108 aa, Artificial Sequence
  source: /note="Description of Artificial Sequence: Synthetic polypeptide"
EIVLTQSPGTLSLSPGERATLSCRASQSFSSTYLAWYQQKPGQAPRLLIYGASSRATGIPDRFSGSGSGTDFTLTISRLEPEDFAVYYCQQYVTSPWTFGQGTKVEIK

SEQ ID NO: 2236 - protein, 9 aa, Artificial Sequence
  source: /note="Description of Artificial Sequence: Synthetic peptide"
QQYVTSPWT

SEQ ID NO: 2237 - protein, 117 aa, Artificial Sequence
  source: /note="Description of Artificial Sequence: Synthetic polypeptide"
EVQLVESGGGLVQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 2238 - protein, 11 aa, Artificial Sequence
  source: /note="Description of Artificial Sequence: Synthetic peptide"
ARDYGDFYFDY

SEQ ID NO: 2239 - protein, 107 aa, Artificial Sequence; identical to SEQ ID NO: 1103
  source: /note="Description of Artificial Sequence: Synthetic polypeptide"

SEQ ID NO: 2240 - protein, 9 aa, Artificial Sequence
  source: /note="Description of Artificial Sequence: Synthetic peptide"
QQYNNWPRT

SEQ ID NO: 2241 - protein, 120 aa, Artificial Sequence
  source: /note="Description of Artificial Sequence: Synthetic polypeptide"
EVQLVESGGGLVQPGGSLRLSCAASGFNFSTHWMHWVRQAPGKGLVWVSRINSDGSRRAYATSVKGRFTISRDNAKNTLYLQMDSLRDEDTAVYYCTRDDSSWPHFFDNWGQGTLVAVSS

SEQ ID NO: 2242 - protein, 13 aa, Artificial Sequence
  source: /note="Description of Artificial Sequence: Synthetic peptide"
TRDDSSWPHFFDN

SEQ ID NO: 2243 - protein, 109 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPPKLTFGGGTKVEIK

SEQ ID NO: 2244 - protein, 11 aa, Artificial Sequence
  source: /note="Description of Artificial Sequence: Synthetic peptide"
QQYDNLPPKLT

SEQ ID NO: 2245 - protein, 120 aa, Artificial Sequence; identical to SEQ ID NO: 377
  source: /note="Description of Artificial Sequence: Synthetic polypeptide"

SEQ ID NO: 2246 - protein, 13 aa, Artificial Sequence
  source: /note="Description of Artificial Sequence: Synthetic peptide"
TRDDSSWPHFFDN

SEQ ID NO: 2247 - protein, 107 aa, Artificial Sequence
  source: /note="Description of Artificial Sequence: Synthetic polypeptide"
DIQMTQSPSSLSASVGDRVTIPCRASQNIDNYLNWYQQKPGKAPKLLIFAASGLQDEAPSRFSGVGSGTDFTLTISSLQPEDSATYYCQQSYISPYTFGRGTKLEIK

SEQ ID NO: 2248 - protein, 9 aa, Artificial Sequence
  source: /note="Description of Artificial Sequence: Synthetic peptide"
QQSYISPYT

SEQ ID NO: 2249 - protein, 119 aa, Artificial Sequence
  source: /note="Description of Artificial Sequence: Synthetic polypeptide"
EVQLVQSGAEVKKPGESLKISCKGSGYTFTSYWIGWVRQMPGKGLEWMGFIYPGDSDTRYSPSFQGQVTISADKSISTAYLQWSSLKASDTAMYYCARPVTYDWYFDLWGRGTLVTVSS

SEQ ID NO: 2250 - protein, 12 aa, Artificial Sequence
  source: /note="Description of Artificial Sequence: Synthetic peptide"
ARPVTYDWYFDL

SEQ ID NO: 2251 - protein, 107 aa, Artificial Sequence
  source: /note="Description of Artificial Sequence: Synthetic polypeptide"
DIQMTQSPSSVSASLGDRVTITCRASQGISSWLAWYQQKPGKAPKVLIYAASSLQSGVPSRFSGSGSGTDFTLTISSLQPEDFATYYCQQANSFPITFGQGTRLEIK

SEQ ID NO: 2252 - protein, 9 aa, Artificial Sequence
  source: /note="Description of Artificial Sequence: Synthetic peptide"
QQANSFPIT

SEQ ID NO: 2253 - protein, 124 aa, Artificial Sequence
  source: /note="Description of Artificial Sequence: Synthetic polypeptide"
EVQLVQSGAEVKKPGESLKISCKVSGYTFTNYWIGWVRQMPGKGLEWMGIIYPGDSDTRYSPSFQGQVTISADKSIITAYLQWSSLKASDTAMYYCARVPSSSDYGDYGGFEYWGQGTLVTVSS

SEQ ID NO: 2254 - protein, 17 aa, Artificial Sequence
  source: /note="Description of Artificial Sequence: Synthetic peptide"
ARVPSSSDYGDYGGFEY

SEQ ID NO: 2255 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPCSFGQGTKLEIK

SEQ ID NO: 2256 - protein, 9 aa, Artificial Sequence
  source: /note="Description of Artificial Sequence: Synthetic peptide"
QQSYSTPCS

SEQ ID NO: 2257 - protein, 131 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARMVTSGTYYYDNSGYSSSGPFDYWGQGTLVTVSS

SEQ ID NO: 2258 - protein, 24 aa, Artificial Sequence
  source: /note="Description of Artificial Sequence: Synthetic peptide"
ARMVTSGTYYYDNSGYSSSGPFDY

SEQ ID NO: 2259 - protein, 103 aa, Artificial Sequence
  source: /note="Description of Artificial Sequence: Synthetic polypeptide"
AIQLTQSPSSLSASVGDRVTITCRASQGISSALAWYQQKPGKAPKLLIYDASSLESGVPSRFSGSGSGTDFTLTISSLQPEDFATYYCQQFNNFGPGTKVDIK

SEQ ID NO: 2260 - protein, 5 aa, Artificial Sequence
  source: /note="Description of Artificial Sequence: Synthetic peptide"
QQFNN

SEQ ID NO: 2261 - protein, 120 aa, Artificial Sequence; identical to SEQ ID NO: 131
  source: /note="Description of Artificial Sequence: Synthetic polypeptide"

SEQ ID NO: 2262 - protein, 13 aa, Artificial Sequence
  source: /note="Description of Artificial Sequence: Synthetic peptide"
ARLSDRWYSPFDP

SEQ ID NO: 2263 - protein, 110 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWPPGGFTFGPGTKVDIK

SEQ ID NO: 2264 - protein, 12 aa, Artificial Sequence
  source: /note="Description of Artificial Sequence: Synthetic peptide"
QQYNNWPPGGFT

SEQ ID NO: 2265 - protein, 129 aa, Artificial Sequence
  source: /note="Description of Artificial Sequence: Synthetic polypeptide"
QVQLVQSGAELKKPGASVKVSCKASGYTFNSYGISWVRQAPGQGLEWMGGISAYNGNTNYAQKLQGRVTMTTDTSTSTAYMELRSLRSDDTAVYYCARRVEDNGDDGGDYYYYYGMDVWGQGTTVTVSS

SEQ ID NO: 2266 - protein, 22 aa, Artificial Sequence
  source: /note="Description of Artificial Sequence: Synthetic peptide"
ARRVEDNGDDGGDYYYYYGMDV

SEQ ID NO: 2267 - protein, 108 aa, Artificial Sequence
  source: /note="Description of Artificial Sequence: Synthetic polypeptide"
SYVLTQPPSVSVSPGQTARITCSGEALPKQYAYWYQQKPGQAPVMVIYKDSERPSGIPERFSGSSSGTTVTLTISGVQAEDDADYYCQSADSSGTLVVFGGGTKLTVL

SEQ ID NO: 2268 - protein, 11 aa, Artificial Sequence
  source: /note="Description of Artificial Sequence: Synthetic peptide"
QSADSSGTLVV

SEQ ID NO: 2269 - protein, 127 aa, Artificial Sequence
  source: /note="Description of Artificial Sequence: Synthetic polypeptide"
QVQLVQSGAEVKKPGASVKVSCKASGYTFTGYSMHWVRQAPGQGLEWMGWINPNSGGTNYAQKFQGRVTMTRDTSISTAYMELSRLGSDDTAVYYCARDLEYCSSTSCYTSTTFDYWGQGTLVTVSS

SEQ ID NO: 2270 - protein, 20 aa, Artificial Sequence
  source: /note="Description of Artificial Sequence: Synthetic peptide"
ARDLEYCSSTSCYTSTTFDY

SEQ ID NO: 2271 - protein, 105 aa, Artificial Sequence
  source: /note="Description of Artificial Sequence: Synthetic polypeptide"
SYVLTQPPSVSVAPGKTARITCGGNNIGSKSVHWYQQKPGQAPVLVVYDDSDRPSGIPERFSGSNSGNTATLTISRVEAGDEADYYCQVWDYGVVFAGGTKLTVL

SEQ ID NO: 2272 - protein, 8 aa, Artificial Sequence
  source: /note="Description of Artificial Sequence: Synthetic peptide"
QVWDYGVV

SEQ ID NO: 2273 - protein, 126 aa, Artificial Sequence
  source: /note="Description of Artificial Sequence: Synthetic polypeptide"
QVQLVQSGAEVKKPGASVKVSCKASGYTFTDYYMHWVRQAPGQGLEWMGWINPNSGGTNYAQKFQGRVTMTRDTSISTAYMELSRLRSDDTAVYYCASGIGHNWNYVSTPNGMDVWGQGTTVTVSS

SEQ ID NO: 2274 - protein, 19 aa, Artificial Sequence
  source: /note="Description of Artificial Sequence: Synthetic peptide"
ASGIGHNWNYVSTPNGMDV

SEQ ID NO: 2275 - protein, 109 aa, Artificial Sequence
  source: /note="Description of Artificial Sequence: Synthetic polypeptide"
NFMLTQPHSVSESPGKTVTISCTRSSGSIASNYVQWYQQRPGSAPTTVIYEDYQRPSGVPDRFSGSIDSSSNSASLTISGLKTEDEADYYCQSYDSGVVFGGGTKLTVL

SEQ ID NO: 2276 - protein, 8 aa, Artificial Sequence
  source: /note="Description of Artificial Sequence: Synthetic peptide"
QSYDSGVV

SEQ ID NO: 2277 - protein, 122 aa, Artificial Sequence
  source: /note="Description of Artificial Sequence: Synthetic polypeptide"
QVQLVQSGAEVKKPGASVRVSCKASGYTFTGYYIHWVRQAPGQGLEWMGWINPMSGGTNYTQKFQGWVTMTRDTSINTAYMELSRLRSDDTAVYYCARDFAMGTVTGTFVYWGQGTLVTVSS

SEQ ID NO: 2278 - protein, 15 aa, Artificial Sequence
  source: /note="Description of Artificial Sequence: Synthetic peptide"
ARDFAMGTVTGTFVY

SEQ ID NO: 2279 - protein, 110 aa, Artificial Sequence
  source: /note="Description of Artificial Sequence: Synthetic polypeptide"
  MOD_RES (2)..(3): Any amino acid
QXXLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGTGTKVTVL

SEQ ID NO: 2280 - protein, 10 aa, Artificial Sequence
  source: /note="Description of Artificial Sequence: Synthetic peptide"
SSYAGSNNWV

SEQ ID NO: 2281 - protein, 120 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCAREGVGGTSYFDYWGQGTLVTVSS

SEQ ID NO: 2282 - protein, 13 aa, Artificial Sequence
  source: /note="Description of Artificial Sequence: Synthetic peptide"
AREGVGGTSYFDY

SEQ ID NO: 2283 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVVYDDSDRPSGIPERFSGSNSGNTATLTISRVEAGDEADYYCQVWDSSSDPYVFGTGTKVTVL

SEQ ID NO: 2284 - protein, 11 aa, Artificial Sequence
  source: /note="Description of Artificial Sequence: Synthetic peptide"
QVWDSSSDPYV

SEQ ID NO: 2285 - protein, 123 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDGLSGHFPHNWFDPWGQGTLVTVSS

SEQ ID NO: 2286 - protein, 16 aa, Artificial Sequence
  source: /note="Description of Artificial Sequence: Synthetic peptide"
ARDGLSGHFPHNWFDP

SEQ ID NO: 2287 - protein, 110 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLRGVFGGGTKLTVL

SEQ ID NO: 2288 - protein, 10 aa, Artificial Sequence
  source: /note="Description of Artificial Sequence: Synthetic peptide"
QSYDSSLRGV

SEQ ID NO: 2289 - protein, 126 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARREAYGPRDYYYYYGMDVWGQGTTVTVSS

SEQ ID NO: 2290 - protein, 19 aa, Artificial Sequence
  source: /note="Description of Artificial Sequence: Synthetic peptide"
ARREAYGPRDYYYYYGMDV

SEQ ID NO: 2291 - protein, 116 aa, Artificial Sequence
  source: /note="Description of Artificial Sequence: Synthetic polypeptide"
  MOD_RES (3)..(4): Any amino acid
QSXXTQPPSASASLGASVTLTCTLSSGYSNYKVDWYQQRPGKGPRFVMRVGTGGIVGSKGDGIPDRFSVLGSGLNRYLTIKNIQEEDESDYHCGADQGSGSNFVGVFGGGTKLTVL

SEQ ID NO: 2292 - protein, 13 aa, Artificial Sequence
  source: /note="Description of Artificial Sequence: Synthetic peptide"
GADQGSGSNFVGV

SEQ ID NO: 2293 - protein, 125 aa, Artificial Sequence
  source: /note="Description of Artificial Sequence: Synthetic polypeptide"
QVQLVQSGAEVKKPGSSVKVSCKASGGTFSSYAISWGRQAPGQGLEWMGGIIPILGTVNYAQKFQGRVTITADKSTSTAYMELSSLRSEDTAVYYCARVLGYYDSSGSNDAFDIWGQGTMVTVSS

SEQ ID NO: 2294 - protein, 18 aa, Artificial Sequence
  source: /note="Description of Artificial Sequence: Synthetic peptide"
ARVLGYYDSSGSNDAFDI

SEQ ID NO: 2295 - protein, 111 aa, Artificial Sequence
  source: /note="Description of Artificial Sequence: Synthetic polypeptide"
  MOD_RES (3)..(4): Any amino acid
QSXXTQPPSVSGAPGQRVTISCTGSSSNIGAGYDVHWYQQLPGTAPKLLIYANINRPSGVPDRFSGSKSGTSASLAITGLQAEDEADYYCQSYDSSLSGSVFGGGTKLTVL

SEQ ID NO: 2296 - protein, 11 aa, Artificial Sequence
  source: /note="Description of Artificial Sequence: Synthetic peptide"
QSYDSSLSGSV

SEQ ID NO: 2297 - protein, 127 aa, Artificial Sequence
  source: /note="Description of Artificial Sequence: Synthetic polypeptide"
  MOD_RES (88)..(88): Any amino acid
QVQLVQSGAEVKKPGASVKVSCKASGYTFTSYDINWVRQATGQGLEWMGWMNPNSGNTGYAQKFQGRVTITRDTSISTAYMELSSLRXEDTAVYYCARGGRYCSDVSCYSGTGFDYWGQGTLVTVSS

SEQ ID NO: 2298 - protein, 20 aa, Artificial Sequence
  source: /note="Description of Artificial Sequence: Synthetic peptide"
ARGGRYCSDVSCYSGTGFDY

SEQ ID NO: 2299 - protein, 111 aa, Artificial Sequence; identical to SEQ ID NO: 1007
  source: /note="Description of Artificial Sequence: Synthetic polypeptide"

SEQ ID NO: 2300 - protein, 12 aa, Artificial Sequence
  source: /note="Description of Artificial Sequence: Synthetic peptide"
AAWDDSLSGYWV

SEQ ID NO: 2301 - protein, 125 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLGYCSSTNCYYYYWGQGTLVTVSS

SEQ ID NO: 2302 - protein, 16 aa, Artificial Sequence
  source: /note="Description of Artificial Sequence: Synthetic peptide"
TTDLGYCSSTNCYYYY

SEQ ID NO: 2303 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKLTVL

SEQ ID NO: 2304 - protein, 11 aa, Artificial Sequence
  source: /note="Description of Artificial Sequence: Synthetic peptide"
QVWDSSSDHPV

SEQ ID NO: 2305 - protein, 123 aa, Artificial Sequence
  source: /note="Description of Artificial Sequence: Synthetic polypeptide"
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDDPGSYYYGMDVWGQGTTVTVSS

SEQ ID NO: 2306 - protein, 14 aa, Artificial Sequence
  source: /note="Description of Artificial Sequence: Synthetic peptide"
TTDDPGSYYYGMDV

SEQ ID NO: 2307 - protein, 109 aa, Artificial Sequence
  source: /note="Description of Artificial Sequence: Synthetic polypeptide"
QSVLTQEPSLTVSPGGTVTLTCGSSTGAVTSGHYPYWFQQKPGQAPRTLIYDTSNKHSWTPARFSGSLLGGKGALTLSGAQPEDEAEYYCLLSYSGARVFGGGTKLTVL

SEQ ID NO: 2308 - protein, 9 aa, Artificial Sequence
  source: /note="Description of Artificial Sequence: Synthetic peptide"
LLSYSGARV

SEQ ID NO: 2309 - protein, 120 aa, Artificial Sequence
  source: /note="Description of Artificial Sequence: Synthetic polypeptide"
QVQLVESGGGVVQPGRSLRLSCAASGFTFSSYAMHWVRQAPGKGLEWVALISYDGSNKHYADSVKGRFTISRDNSKNTLYLQMNSLRAEDTAVYYCARAGTTNSDYFDYWGQGTLVTVSS

SEQ ID NO: 2310 - protein, 13 aa, Artificial Sequence
  source: /note="Description of Artificial Sequence: Synthetic peptide"
ARAGTTNSDYFDY

SEQ ID NO: 2311 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDTDRPSGIPERFSGSNSGNTATLTISRVEAGDEADYYCQVWDSSSALWVFGGGTKLTVL

SEQ ID NO: 2312 - protein, 11 aa, Artificial Sequence
  source: /note="Description of Artificial Sequence: Synthetic peptide"
QVWDSSSALWV

SEQ ID NO: 2313 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGYSYGYSLYYFDYWGQGTLVTVSS

SEQ ID NO: 2314 - protein, 16 aa, Artificial Sequence
  source: /note="Description of Artificial Sequence: Synthetic peptide"
AKGGYSYGYSLYYFDY

SEQ ID NO: 2315 - protein, 110 aa, Artificial Sequence
  source: /note="Description of Artificial Sequence: Synthetic polypeptide"
  MOD_RES (2)..(4): Any amino acid
QXXXTQPASVSGSPGQSITISCTGTSSDVGGYNYVSWHQQHPGKAPKLMIYDVSNRPSGVSNRFSGSKSGNTASLTISGLQAEDEADYYCSSYTSSSTLVFGGGTKLTVL

SEQ ID NO: 2316 - protein, 10 aa, Artificial Sequence
  source: /note="Description of Artificial Sequence: Synthetic peptide"
SSYTSSSTLV

SEQ ID NO: 2317 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAQYSYGYVVYYFDYWGQGALVTVSS

SEQ ID NO: 2318 - protein, 16 aa, Artificial Sequence
  source: /note="Description of Artificial Sequence: Synthetic peptide"
AKAQYSYGYVVYYFDY

SEQ ID NO: 2319 - protein, 110 aa, Artificial Sequence
  source: /note="Description of Artificial Sequence: Synthetic polypeptide"
NFMLTQPHSVSESPGKTVTISCTRSSGSIASNYVQWYQQRPGSSPTIVIYEDNQRPSGVPDRFSGSIDSSSNSASLTISGLKTEDEADYYCQSYDSSNVVFGGGTKLTVL

SEQ ID NO: 2320 - protein, 9 aa, Artificial Sequence
  source: /note="Description of Artificial Sequence: Synthetic peptide"
QSYDSSNVV

SEQ ID NO: 2321 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVISSGGGTFYADSVKGRFTISRDNSKNTLYLQMNSLRAEDTAVYYCARSLWLRGSFQHWGQGTLVTVSS

SEQ ID NO: 2322 - protein, 12 aa, Artificial Sequence
  source: /note="Description of Artificial Sequence: Synthetic peptide"
ARSLWLRGSFQH

SEQ ID NO: 2323 - protein, 110 aa, Artificial Sequence
  source: /note="Description of Artificial Sequence: Synthetic polypeptide"
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSSWVFGGGTKLTVL

SEQ ID NO: 2324 - protein, 9 aa, Artificial Sequence
  source: /note="Description of Artificial Sequence: Synthetic peptide"
QSYDSSSWV

SEQ ID NO: 2325 - protein, 121 aa, Artificial Sequence
  source: /note="Description of Artificial Sequence: Synthetic polypeptide"
EVQLVESGGGLVQPGGSLRLSCAASGFTFSSYWMSWVRQAPGKGLEWVATIKQDGSEKYYVDSVKGRFTISRDNAKNSLYLQMNSLRAEDTAVYYCARGDYDFWSGYYDYWGQGTLVTVSS

SEQ ID NO: 2326 - protein, 14 aa, Artificial Sequence
  source: /note="Description of Artificial Sequence: Synthetic peptide"
ARGDYDFWSGYYDY

SEQ ID NO: 2327 - protein, 106 aa, Artificial Sequence
  source: /note="Description of Artificial Sequence: Synthetic polypeptide"
  MOD_RES (3)..(3): Any amino acid
SYXLTQPPSVSVSPGQTARITCSGDAFPNQYAYWYQQKPGQAPVLVIYKDSERPSGIPERFSGSSSGTTVTLTISGVQAEDEADYYCQSADSSSWVFGGGTKLTVL

SEQ ID NO: 2328 - protein, 9 aa, Artificial Sequence
  source: /note="Description of Artificial Sequence: Synthetic peptide"
QSADSSSWV

SEQ ID NO: 2329 - protein, 119 aa, Artificial Sequence
  source: /note="Description of Artificial Sequence: Synthetic polypeptide"
EVQLVESGGGLVQPGGSLRLSCAASRFTFSSYWMSWVRQAPGKGLEWVANIKQDGSEKYYVDSVKGRFTISRDNAKNSLYLQMNSLRAEDTAVYYCATAPWLRGGFDYWGQGTLVTVSS

SEQ ID NO: 2330 - protein, 12 aa, Artificial Sequence
  source: /note="Description of Artificial Sequence: Synthetic peptide"
ATAPWLRGGFDY

SEQ ID NO: 2331 - protein, 111 aa, Artificial Sequence
  source: /note="Description of Artificial Sequence: Synthetic polypeptide"
NFMLTQPHSVSESPGKTVTISCTRSSGSIASNYVQWYQQRPGSSPTTVIYEDSQRPSGVPDRFSGSIDSSSNSASLTISGLKTEDEADYYCQSFDSTNLWVFGGGTKLTVL

SEQ ID NO: 2332 - protein, 10 aa, Artificial Sequence
  source: /note="Description of Artificial Sequence: Synthetic peptide"
QSFDSTNLWV

SEQ ID NO: 2333 - protein, 130 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGVSWNSGTIGYADSVKGRFTISRDNAKNSLYLQMNSLRAEDTALYYCAKIADIVRAYDFWSGQHFDAFDIWGQGTMVTVSS

SEQ ID NO: 2334 - protein, 23 aa, Artificial Sequence
  source: /note="Description of Artificial Sequence: Synthetic peptide"
AKIADIVRAYDFWSGQHFDAFDI

SEQ ID NO: 2335 - protein, 108 aa, Artificial Sequence
  source: /note="Description of Artificial Sequence: Synthetic polypeptide"
QSALTQPPSASGTPGQRVTISCSGSSSNIGSNTVNWYQQLPGTAPKLLIYSNNQRPSGVPDRFSGSKSGTSASLAISGLQSEDEADYYCAAWDDSLVVFGGGTKLTVL

SEQ ID NO: 2336 - protein, 9 aa, Artificial Sequence
  source: /note="Description of Artificial Sequence: Synthetic peptide"
AAWDDSLVV

SEQ ID NO: 2337 - protein, 125 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGIIGYADSVMGRFTISRDNAKNSLYLQMNSLRAEDTALYYCAKDGGSGTTEYEAYYFDYWGQGTLVTVSS

SEQ ID NO: 2338 - protein, 18 aa, Artificial Sequence
  source: /note="Description of Artificial Sequence: Synthetic peptide"
AKDGGSGTTEYEAYYFDY

SEQ ID NO: 2339 - protein, 110 aa, Artificial Sequence; identical to SEQ ID NO: 98
  source: /note="Description of Artificial Sequence: Synthetic polypeptide"

SEQ ID NO: 2340 - protein, 11 aa, Artificial Sequence
  source: /note="Description of Artificial Sequence: Synthetic peptide"
AAWDDSLNGVV

SEQ ID NO: 2341 - protein, 124 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGTIGYADSVQGRFIISRDNAKNSLYLQMNSLRAEDTALYYCAKDMGRDDSSGSLLFDYWGQGTLVTVSS

SEQ ID NO: 2342 - protein, 17 aa, Artificial Sequence
  source: /note="Description of Artificial Sequence: Synthetic peptide"
AKDMGRDDSSGSLLFDY

SEQ ID NO: 2343 - protein, 108 aa, Artificial Sequence
  source: /note="Description of Artificial Sequence: Synthetic polypeptide"
SYVLTQPPSVSVAPGKTARITCGGNNIGSKSVHWFQQKPGQAPVLVVYDDSDRPSGIPERFSGSNSGNTATLTISRVEAGDEADYYCQVWDSSSDHVVFGGGTKLTVL

SEQ ID NO: 2344 - protein, 11 aa, Artificial Sequence
  source: /note="Description of Artificial Sequence: Synthetic peptide"
QVWDSSSDHVV

SEQ ID NO: 2345 - protein, 125 aa, Artificial Sequence
  source: /note="Description of Artificial Sequence: Synthetic polypeptide"
EVQLVESGGGLIQPGRSLRLSCAASGFTFDDYAMHWVRQAPGKGLEWVSGTSWNSGTIGYADSVKGRFTISRDNAKNSLYLQMNRLRAEDTALYHCAKDIGSKRSTSENYGMDVWGQGTTVTVSS

SEQ ID NO: 2346 - protein, 18 aa, Artificial Sequence
  source: /note="Description of Artificial Sequence: Synthetic peptide"
AKDIGSKRSTSENYGMDV

SEQ ID NO: 2347 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVVYDDSDRPSGIPERFSGSNSGNTATLTISKVEAGDEADYYCQVWDSSSDSVVFGGGTKLTVL

SEQ ID NO: 2348 - protein, 11 aa, Artificial Sequence
  source: /note="Description of Artificial Sequence: Synthetic peptide"
QVWDSSSDSVV

SEQ ID NO: 2349 - protein, 130 aa, Artificial Sequence
  source: /note="Description of Artificial Sequence: Synthetic polypeptide"
QLQLQESGPGLVKPSETLSLTCTVSGGSITSSSYYWGWIRQPPGKGLEWIGTIYYGGSTYYNPSLKSRVTISVDTSKNQISLKLSSVTAADTAVYYCASLRGAYYDFWSGPRDGGWFDPWGQGTLVTVSS

SEQ ID NO: 2350 - protein, 22 aa, Artificial Sequence
  source: /note="Description of Artificial Sequence: Synthetic peptide"
ASLRGAYYDFWSGPRDGGWFDP

SEQ ID NO: 2351 - protein, 110 aa, Artificial Sequence
  source: /note="Description of Artificial Sequence: Synthetic polypeptide"
  MOD_RES (2)..(4): Any amino acid
QXXXTQPASVSGSPGQSITISCTGTSSDVGSYNLVSWYQQHPGKAPKLMIYEDSKRPSGVSNRFSGSKSGNTASLTISGLQAEDEADYYCCSYAGSSLWVFGGGTKLTVL

SEQ ID NO: 2352 - protein, 10 aa, Artificial Sequence
  source: /note="Description of Artificial Sequence: Synthetic peptide"
CSYAGSSLWV

SEQ ID NO: 2353 - protein, 120 aa, Artificial Sequence
  source: /note="Description of Artificial Sequence: Synthetic polypeptide"
QVQLQESGPGLVKPSQTLSLTCTVSGGSISSGSYYWSWIRQPAGKGLEWIGHIYTSGSTNYNPSLKSRVTISVDTSKNQFSLKLSSVTAADTAVYYCAREIPSTWYFDLWGRGTLVTVSS

SEQ ID NO: 2354 - protein, 12 aa, Artificial Sequence
  source: /note="Description of Artificial Sequence: Synthetic peptide"
AREIPSTWYFDL

SEQ ID NO: 2355 - protein, 111 aa, Artificial Sequence; identical to SEQ ID NO: 1007
  source: /note="Description of Artificial Sequence: Synthetic polypeptide"

SEQ ID NO: 2356 - protein, 12 aa, Artificial Sequence
  source: /note="Description of Artificial Sequence: Synthetic peptide"
AAWDDSLSGYWV

SEQ ID NO: 2357 - protein, 120 aa, Artificial Sequence
  source: /note="Description of Artificial Sequence: Synthetic polypeptide"
QVQLQESGPGLVKPSQTLSLTCTVSGGSISSGNYYLTWIRQPAGKGLEWIGHIYTSGSTNYNPSLKSRVTISVDTSMNQFSLKLSSVTAADTAVYYCARDIPPTWYFDLWGRGTLVTVSS

SEQ ID NO: 2358 - protein, 12 aa, Artificial Sequence
  source: /note="Description of Artificial Sequence: Synthetic peptide"
ARDIPPTWYFDL

SEQ ID NO: 2359 - protein, 110 aa, Artificial Sequence
  source: /note="Description of Artificial Sequence: Synthetic polypeptide"
SYVLTQPPSVSVAPGKTARITCGGNNIGSKNVHWYQQKPGQAPVLVVYDDSDRPSGIPERFSGSNSGNTATLTISRVEAGDEAGYYCQVWDSTSDHLFWVFGGGTKLTVL

SEQ ID NO: 2360 - protein, 13 aa, Artificial Sequence
  source: /note="Description of Artificial Sequence: Synthetic peptide"
QVWDSTSDHLFWV

SEQ ID NO: 2361 - protein, 120 aa, Artificial Sequence
  source: /note="Description of Artificial Sequence: Synthetic polypeptide"
EVQLVQSGAEVKKPGESLKISCKGSGYSFTSHWIGWVRQMPGKGLEWMGIIYPGDSDTRYSPSFQGQVTISADKSISTAYLQWSSLKASDTAMYYCARLPSGRYNWFDPWGQGTLVTVSS

SEQ ID NO: 2362 - protein, 13 aa, Artificial Sequence
  source: /note="Description of Artificial Sequence: Synthetic peptide"
ARLPSGRYNWFDP

SEQ ID NO: 2363 - protein, 111 aa, Artificial Sequence
  source: /note="Description of Artificial Sequence: Synthetic polypeptide"
  MOD_RES (3)..(4): Any amino acid
QSXXTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL

SEQ ID NO: 2364 - protein, 12 aa, Artificial Sequence
  source: /note="Description of Artificial Sequence: Synthetic peptide"
AAWDDSLNGHVV

SEQ ID NO: 2365 - protein, 138 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTTYSPSFQGQVTISADKSVTTAYLQWSSLKASDTAMYYCARLPQEEKRFLEWLPPANVRKQIPYYYGMDVWGQGTTVTVSS

SEQ ID NO: 2366 - protein, 31 aa, Artificial Sequence
  source: /note="Description of Artificial Sequence: Synthetic polypeptide"
ARLPQEEKRFLEWLPPANVRKQIPYYYGMDV

SEQ ID NO: 2367 - protein, 113 aa, Artificial Sequence
  source: /note="Description of Artificial Sequence: Synthetic polypeptide"
  MOD_RES (3)..(3): Any amino acid
QSXLTQPPSVSGAPGQRVTISCTGSSSNIGADYDVHWYQQLPGTAPKLLIYGNSNRPSGVPDRFSGSKSGTSASLAITGLQAEDEADYYCQSYDSSLSGPYWVFGGGTKLTVL

SEQ ID NO: 2368 - protein, 13 aa, Artificial Sequence
  source: /note="Description of Artificial Sequence: Synthetic peptide"
QSYDSSLSGPYWV

SEQ ID NO: 2369 - protein, 11 aa, Artificial Sequence
  source: /note="Description of Artificial Sequence: Synthetic peptide"
ARDWGEYYFDY

SEQ ID NO: 2370 - protein, 107 aa, Artificial Sequence
  source: /note="Description of Artificial Sequence: Synthetic polypeptide"
EIVLTQSPGTLSLSPGERATLSCRASQSVTSYLAWYQQKPGQAPRLLIYGASSRATGIPDRFSGSGSGTDFTLTISRLDPEDFAVYYCQQYGSSPRTFGQGTKVEIK

SEQ ID NO: 2371-2372 - skipped (2 entries)

SEQ ID NO: 2373 - protein, 11 aa, Artificial Sequence
  source: /note="Description of Artificial Sequence: Synthetic peptide"
ARDYGDYYFDY

SEQ ID NO: 2374 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPRTFGQGTKVEIK

SEQ ID NO: 2375-2376 - skipped (2 entries)

SEQ ID NO: 2377 - protein, 11 aa, Artificial Sequence
  source: /note="Description of Artificial Sequence: Synthetic peptide"
ARDWGEYYFDY

SEQ ID NO: 2378 - protein, 107 aa, Artificial Sequence; identical to SEQ ID NO: 2370
  source: /note="Description of Artificial Sequence: Synthetic polypeptide"

SEQ ID NO: 2379-2380 - skipped (2 entries)

SEQ ID NO: 2381 - protein, 11 aa, Artificial Sequence
  source: /note="Description of Artificial Sequence: Synthetic peptide"
ARDYGDYYFDY

SEQ ID NO: 2382 - protein, 108 aa, Artificial Sequence; identical to SEQ ID NO: 52
  source: /note="Description of Artificial Sequence: Synthetic polypeptide"

SEQ ID NO: 2383-2384 - skipped (2 entries)

SEQ ID NO: 2385 - protein, 11 aa, Artificial Sequence
  source: /note="Description of Artificial Sequence: Synthetic peptide"
VRDYGDFYFDY

SEQ ID NO: 2386 - protein, 108 aa, Artificial Sequence; identical to SEQ ID NO: 50
  source: /note="Description of Artificial Sequence: Synthetic polypeptide"

SEQ ID NO: 2387-2388 - skipped (2 entries)

SEQ ID NO: 2389 - protein, 17 aa, Artificial Sequence
  source: /note="Description of Artificial Sequence: Synthetic peptide"
ARKPLLYSDFSPGAFDI

SEQ ID NO: 2390 - protein, 107 aa, Artificial Sequence; identical to SEQ ID NO: 156
  source: /note="Description of Artificial Sequence: Synthetic polypeptide"

SEQ ID NO: 2391-2392 - skipped (2 entries)

SEQ ID NO: 2393 - protein, 17 aa, Artificial Sequence
  source: /note="Description of Artificial Sequence: Synthetic peptide"
ARKPLLYSNLSPGAFDI

SEQ ID NO: 2394 - protein, 108 aa, Artificial Sequence
  source: /note="Description of Artificial Sequence: Synthetic polypeptide"
EIVLTQSPGTLSLSPGERATLSCWASQSVSASYLAWYQQKPGQAPRLLIYGASSRATGIPDRFSGSGSGTDFTLTISRLEPEDFAVYYCQQYGTTPRTFGGGTKVEIK

SEQ ID NO: 2395-2396 - skipped (2 entries)

SEQ ID NO: 2397 - protein, 17 aa, Artificial Sequence
  source: /note="Description of Artificial Sequence: Synthetic peptide"
ARKTLLFSDFSPGAFDI

SEQ ID NO: 2398 - protein, 107 aa, Artificial Sequence; identical to SEQ ID NO: 154
  source: /note="Description of Artificial Sequence: Synthetic polypeptide"

SEQ ID NO: 2399-2400 - skipped (2 entries)

SEQ ID NO: 2401 - protein, 17 aa, Artificial Sequence
  source: /note="Description of Artificial Sequence: Synthetic peptide"
ARKPLLHSDLSPGAFDI

SEQ ID NO: 2402 - protein, 107 aa, Artificial Sequence; identical to SEQ ID NO: 158
  source: /note="Description of Artificial Sequence: Synthetic polypeptide"

SEQ ID NO: 2403-2404 - skipped (2 entries)

SEQ ID NO: 2405 - protein, 17 aa, Artificial Sequence
  source: /note="Description of Artificial Sequence: Synthetic peptide"
ARKPLLYSDFSPGAFDI

SEQ ID NO: 2406 - protein, 107 aa, Artificial Sequence
  source: /note="Description of Artificial Sequence: Synthetic polypeptide"
EIVLTQSPGTLSLSPGERATLSCRASQTVTANYLAWYQQKPGQAPRLLIYGASKRATGIPDRFSGSGSGTDFTLSISRLEPEDFAVYYCQQYTTTPRTFGGGTKVEI

SEQ ID NO: 2407-2408 - skipped (2 entries)

SEQ ID NO: 2409 - protein, 12 aa, Artificial Sequence
  source: /note="Description of Artificial Sequence: Synthetic peptide"
ARGEGWDLPYDY

SEQ ID NO: 2410 - protein, 111 aa, Artificial Sequence
  source: /note="Description of Artificial Sequence: Synthetic polypeptide"
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFVVFGGGTKLTVL

SEQ ID NO: 2411 - protein, 9 aa, Artificial Sequence
  source: /note="Description of Artificial Sequence: Synthetic peptide"
QQYGSSPRT

SEQ ID NO: 2412 - skipped

SEQ ID NO: 2413 - protein, 12 aa, Artificial Sequence
  source: /note="Description of Artificial Sequence: Synthetic peptide"
ARGEGWDLPYDY

SEQ ID NO: 2414 - protein, 111 aa, Artificial Sequence
  source: /note="Description of Artificial Sequence: Synthetic polypeptide"
QSVLTQPPSASGSPGQSVTISCTGTSSDVGGYNYVSWYQQHPGKAPKLMIYEVRKRPSGVPDRFSGSKSGNTASLTVSGLQAEDEADYYCSSYAGSNNFVLFGGGTKLTVL

SEQ ID NO: 2415 - protein, 9 aa, Artificial Sequence
  source: /note="Description of Artificial Sequence: Synthetic peptide"
QQYGSSPRT

SEQ ID NO: 2416 - skipped

SEQ ID NO: 2417 - protein, 12 aa, Artificial Sequence
  source: /note="Description of Artificial Sequence: Synthetic peptide"
ARGEGWELPYDY

SEQ ID NO: 2418 - protein, 111 aa, Artificial Sequence
  source: /note="Description of Artificial Sequence: Synthetic polypeptide"
QSVLTQPPSASGSPGQSVTISCTGTSSDVGGYKYVSWYQQHPGKAPKLMIYEVSKRPSGVPDRFSGSKSGNTASLTVSGLQAEDEADYYCSSYEGSNNFVVFGGGTKLTVL

SEQ ID NO: 2419 - protein, 9 aa, Artificial Sequence
  source: /note="Description of Artificial Sequence: Synthetic peptide"
QQYGSSPRT

SEQ ID NO: 2420 - skipped

SEQ ID NO: 2421 - protein, 15 aa, Artificial Sequence
  source: /note="Description of Artificial Sequence: Synthetic peptide"
ARGEAVAGTTGFFDY

SEQ ID NO: 2422 - protein, 111 aa, Artificial Sequence; identical to SEQ ID NO: 62
  source: /note="Description of Artificial Sequence: Synthetic polypeptide"

SEQ ID NO: 2423 - protein, 9 aa, Artificial Sequence
  source: /note="Description of Artificial Sequence: Synthetic peptide"
QQYGSSPRT

SEQ ID NO: 2424 - skipped

SEQ ID NO: 2425 - protein, 15 aa, Artificial Sequence
  source: /note="Description of Artificial Sequence: Synthetic peptide"
ARGEAVAGTTGFFDY

SEQ ID NO: 2426 - protein, 111 aa, Artificial Sequence; identical to SEQ ID NO: 62
  source: /note="Description of Artificial Sequence: Synthetic polypeptide"

SEQ ID NO: 2427 - protein, 9 aa, Artificial Sequence
  source: /note="Description of Artificial Sequence: Synthetic peptide"
QQYGSSPRT

SEQ ID NO: 2428 - skipped

SEQ ID NO: 2429 - protein, 18 aa, Artificial Sequence
  source: /note="Description of Artificial Sequence: Synthetic peptide"
ARDVIVSMVRGVIFRMDV

SEQ ID NO: 2430 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSNNQRPSGVPDRFSVSKSGTSASLAISGLQSEDEADYYCAAWDDSLNGVVFGGGTKLTVL

SEQ ID NO: 2431 - protein, 9 aa, Artificial Sequence
  source: /note="Description of Artificial Sequence: Synthetic peptide"
QQYHTTPRT

SEQ ID NO: 2432 - skipped

SEQ ID NO: 2433 - protein, 18 aa, Artificial Sequence
  source: /note="Description of Artificial Sequence: Synthetic peptide"
ATAHPRRIQGVFFLGPGV

SEQ ID NO: 2434 - protein, 110 aa, Artificial Sequence; identical to SEQ ID NO: 98
  source: /note="Description of Artificial Sequence: Synthetic polypeptide"

SEQ ID NO: 2435 - protein, 9 aa, Artificial Sequence
  source: /note="Description of Artificial Sequence: Synthetic peptide"
QQYGTTPRT

SEQ ID NO: 2436 - skipped

SEQ ID NO: 2437 - protein, 20 aa, Artificial Sequence
  source: /note="Description of Artificial Sequence: Synthetic peptide"
ARANHETTMDTYYYYYYMDV

SEQ ID NO: 2438 - protein, 111 aa, Artificial Sequence
  source: /note="Description of Artificial Sequence: Synthetic polypeptide"
QSVLTQPASVSGSPGQSITISCTGTSSDVGGYKYVSWYQRHPGKAPKLMIYDVSNRPSGVSNRFSGSKSGNTASLTISGLQAEDEADYYCSSYTSSSTSVVFGGGTQLTVL

SEQ ID NO: 2439 - protein, 9 aa, Artificial Sequence
  source: /note="Description of Artificial Sequence: Synthetic peptide"
QQYGTTPRT

SEQ ID NO: 2440 - skipped

SEQ ID NO: 2441 - protein, 20 aa, Artificial Sequence
  source: /note="Description of Artificial Sequence: Synthetic peptide"
ARANHETTMDTYYYYYYMDV

SEQ ID NO: 2442 - protein, 111 aa, Artificial Sequence; identical to SEQ ID NO: 82
  source: /note="Description of Artificial Sequence: Synthetic polypeptide"

SEQ ID NO: 2443 - protein, 9 aa, Artificial Sequence
  source: /note="Description of Artificial Sequence: Synthetic peptide"
QQYVTTPRT

SEQ ID NO: 2444 - skipped

SEQ ID NO: 2445 - protein, 16 aa, Artificial Sequence
  source: /note="Description of Artificial Sequence: Synthetic peptide"
AAPHCSSTSCFDAFDI

SEQ ID NO: 2446 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPWTFGQGTKVEIK

SEQ ID NO: 2447 - protein, 9 aa, Artificial Sequence
  source: /note="Description of Artificial Sequence: Synthetic peptide"
QQYTTTPRT

SEQ ID NO: 2448 - skipped

SEQ ID NO: 2449 - protein, 16 aa, Artificial Sequence
  source: /note="Description of Artificial Sequence: Synthetic peptide"
AAPYCSGGSCSDAFDI

SEQ ID NO: 2450 - protein, 108 aa, Artificial Sequence; identical to SEQ ID NO: 44
  source: /note="Description of Artificial Sequence: Synthetic polypeptide"

SEQ ID NO: 2451 - protein, 11 aa, Artificial Sequence
  source: /note="Description of Artificial Sequence: Synthetic peptide"
SSYAGSNNFVV

SEQ ID NO: 2452 - skipped

SEQ ID NO: 2453 - protein, 20 aa, Artificial Sequence
  source: /note="Description of Artificial Sequence: Synthetic peptide"
ARDPIWFGELLSPPFVHFDY

SEQ ID NO: 2454 - protein, 113 aa, Artificial Sequence
  source: /note="Description of Artificial Sequence: Synthetic polypeptide"
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVYVFGTGTTVTVL

SEQ ID NO: 2455 - protein, 11 aa, Artificial Sequence
  source: /note="Description of Artificial Sequence: Synthetic peptide"
SSYAGSNNFVL

SEQ ID NO: 2456 - skipped

SEQ ID NO: 2457 - protein, 20 aa, Artificial Sequence
  source: /note="Description of Artificial Sequence: Synthetic peptide"
ARDPIWFGELLSPPFVHFDY

SEQ ID NO: 2458 - protein, 113 aa, Artificial Sequence; identical to SEQ ID NO: 78
  source: /note="Description of Artificial Sequence: Synthetic polypeptide"

SEQ ID NO: 2459 - protein, 11 aa, Artificial Sequence
  source: /note="Description of Artificial Sequence: Synthetic peptide"
SSYEGSNNFVV

SEQ ID NO: 2460 - skipped

SEQ ID NO: 2461 - protein, 14 aa, Artificial Sequence
  source: /note="Description of Artificial Sequence: Synthetic peptide"
AREDYYDSSGSFDY

SEQ ID NO: 2462 - protein, 110 aa, Artificial Sequence; identical to SEQ ID NO: 68
  source: /note="Description of Artificial Sequence: Synthetic polypeptide"

SEQ ID NO: 2463 - protein, 12 aa, Artificial Sequence
  source: /note="Description of Artificial Sequence: Synthetic peptide"
AAWDDSLSGFVV

SEQ ID NO: 2464 - skipped

SEQ ID NO: 2465 - protein, 14 aa, Artificial Sequence
  source: /note="Description of Artificial Sequence: Synthetic peptide"
AREDYYDSSGSFDY

SEQ ID NO: 2466 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 2467 - protein, 12 aa, Artificial Sequence
  source: /note="Description of Artificial Sequence: Synthetic peptide"
AAWDDSLSGFVV

SEQ ID NO: 2468 - skipped

SEQ ID NO: 2469 - protein, 20 aa, Artificial Sequence
  source: /note="Description of Artificial Sequence: Synthetic peptide"
ASGYTGYDYFVRGDYYGLDV

SEQ ID NO: 2470 - protein, 111 aa, Artificial Sequence
  source: /note="Description of Artificial Sequence: Synthetic polypeptide"
QSVLTQSPSASASLGASVKLTCTLSSGHSSYAIAWHQQQPEKGPRYLMKLNTDGSHSKGDGIPDRFSGSSSGAERYLTISSLQSEDEADYYCQTWGTGILVFGGGTKLTVL

SEQ ID NO: 2471 - protein, 11 aa, Artificial Sequence
  source: /note="Description of Artificial Sequence: Synthetic peptide"
AAWDDSLNGVV

SEQ ID NO: 2472 - skipped

SEQ ID NO: 2473 - protein, 20 aa, Artificial Sequence
  source: /note="Description of Artificial Sequence: Synthetic peptide"
ASGYTGYDYFVGGDYYGMDV

SEQ ID NO: 2474 - protein, 111 aa, Artificial Sequence
  source: /note="Description of Artificial Sequence: Synthetic polypeptide"
QSVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGILVFGGGTKLTVL

SEQ ID NO: 2475 - protein, 11 aa, Artificial Sequence
  source: /note="Description of Artificial Sequence: Synthetic peptide"
AAWDDSLNGVV

SEQ ID NO: 2476 - skipped

SEQ ID NO: 2477 - protein, 18 aa, Artificial Sequence
  source: /note="Description of Artificial Sequence: Synthetic peptide"
ARGVNPDDILTGVDAFDI

SEQ ID NO: 2478 - protein, 107 aa, Artificial Sequence; identical to SEQ ID NO: 70
  source: /note="Description of Artificial Sequence: Synthetic polypeptide"

SEQ ID NO: 2479 - protein, 11 aa, Artificial Sequence
  source: /note="Description of Artificial Sequence: Synthetic peptide"
SSYTSSSTSVV

SEQ ID NO: 2480 - skipped

SEQ ID NO: 2481 - protein, 18 aa, Artificial Sequence
  source: /note="Description of Artificial Sequence: Synthetic peptide"
ARGVNPDDILTGVDAFDI

SEQ ID NO: 2482 - protein, 107 aa, Artificial Sequence; identical to SEQ ID NO: 70
  source: /note="Description of Artificial Sequence: Synthetic polypeptide"

SEQ ID NO: 2483 - protein, 11 aa, Artificial Sequence
  source: /note="Description of Artificial Sequence: Synthetic peptide"
SSYTSSSTSVV

SEQ ID NO: 2484 - skipped

SEQ ID NO: 2485 - protein, 11 aa, Artificial Sequence
  source: /note="Description of Artificial Sequence: Synthetic peptide"
TRWDGWSQHDY

SEQ ID NO: 2486 - protein, 111 aa, Artificial Sequence
  source: /note="Description of Artificial Sequence: Synthetic polypeptide"
DIVMTQSPLSLSVTPGEPASISCRSSQSLLHSNGNNYFDWYLQKPGQSPQLLIYLGSNRASGVPDRFSGSGSGTDFTLKISRVEAEDVGVYYCMQVLQIPYTFGQGTKLEI

SEQ ID NO: 2487 - protein, 9 aa, Artificial Sequence
  source: /note="Description of Artificial Sequence: Synthetic peptide"
QQYGNSPWT

SEQ ID NO: 2488 - skipped

SEQ ID NO: 2489 - protein, 11 aa, Artificial Sequence
  source: /note="Description of Artificial Sequence: Synthetic peptide"
TRWDGWSQHDY

SEQ ID NO: 2490 - protein, 111 aa, Artificial Sequence
  source: /note="Description of Artificial Sequence: Synthetic polypeptide"
DIVMTQSPLSLPVTPGEPASISCRSSQSLLQSNGNNYFDWYLQKPGQSPQLLIYLGSNRASGVPDRFSGSGSGTDFTLKISRVEAEDVGVYYCMQVLQVPYTFGQGTNLEI

SEQ ID NO: 2491 - protein, 9 aa, Artificial Sequence
  source: /note="Description of Artificial Sequence: Synthetic peptide"
QQYGSSPWT

SEQ ID NO: 2492 - skipped

SEQ ID NO: 2493 - protein, 12 aa, Artificial Sequence
  source: /note="Description of Artificial Sequence: Synthetic peptide"
AREGMGMAAAGT

SEQ ID NO: 2494 - protein, 107 aa, Artificial Sequence
  source: /note="Description of Artificial Sequence: Synthetic polypeptide"
DIQMTQSPSSLSASVGDTVTITCQASQDISKYLNWYQQKPGKAPKLLIYDASNLETGVPSRFSGSGSGTDFTFTISSLQPEDIATYYCQQYDNLPQTFGGGTKVEIK

SEQ ID NO: 2495 - protein, 14 aa, Artificial Sequence
  source: /note="Description of Artificial Sequence: Synthetic peptide"
GTWDSSLSAGGVYV

SEQ ID NO: 2496 - skipped

SEQ ID NO: 2497 - protein, 12 aa, Artificial Sequence
  source: /note="Description of Artificial Sequence: Synthetic peptide"
AREGMGIAAAGT

SEQ ID NO: 2498 - protein, 107 aa, Artificial Sequence; identical to SEQ ID NO: 2494
  source: /note="Description of Artificial Sequence: Synthetic polypeptide"

SEQ ID NO: 2499 - protein, 14 aa, Artificial Sequence
  source: /note="Description of Artificial Sequence: Synthetic peptide"
GAWDSSLSAGGVYV

SEQ ID NO: 2500 - skipped

SEQ ID NO: 2501 - protein, 11 aa, Artificial Sequence
  source: /note="Description of Artificial Sequence: Synthetic peptide"
ARGDGELFFDH

SEQ ID NO: 2502 - protein, 110 aa, Artificial Sequence; identical to SEQ ID NO: 72
  source: /note="Description of Artificial Sequence: Synthetic polypeptide"

SEQ ID NO: 2503 - protein, 10 aa, Artificial Sequence
  source: /note="Description of Artificial Sequence: Synthetic peptide"
SSYTSSSTWV

SEQ ID NO: 2504 - skipped

SEQ ID NO: 2505 - protein, 11 aa, Artificial Sequence
  source: /note="Description of Artificial Sequence: Synthetic peptide"
ARGDGELFFDQ

SEQ ID NO: 2506 - protein, 110 aa, Artificial Sequence; identical to SEQ ID NO: 72
  source: /note="Description of Artificial Sequence: Synthetic polypeptide"

SEQ ID NO: 2507 - protein, 10 aa, Artificial Sequence
  source: /note="Description of Artificial Sequence: Synthetic peptide"
SSYTSSSTWV

SEQ ID NO: 2508 - skipped

SEQ ID NO: 2509 - protein, 13 aa, Artificial Sequence
  source: /note="Description of Artificial Sequence: Synthetic peptide"
VRDGGRPGDAFDI

SEQ ID NO: 2510 - protein, 110 aa, Artificial Sequence
  source: /note="Description of Artificial Sequence: Synthetic polypeptide"
QSALTQPASVSGSPGQSITISCTGTSSDVGGYNFVSWYQQHPGKAPKLMIYDVSNRPSGVSNRFSGSKSGNTASLTISGLQAEDEADYYCNSYTSSSTRVFGTGTKVTVL

SEQ ID NO: 2511 - protein, 9 aa, Artificial Sequence
  source: /note="Description of Artificial Sequence: Synthetic peptide"
QTWGTGILV

SEQ ID NO: 2512 - skipped

SEQ ID NO: 2513 - protein, 13 aa, Artificial Sequence
  source: /note="Description of Artificial Sequence: Synthetic peptide"
VRDGGRPGDAFDI

SEQ ID NO: 2514 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGKAPKLMIYDVSNRPSGVSNRFSGSKSGNTASLTISGLQAEDEADYYCNSYTSSSTRVFGTGTKVTVL

SEQ ID NO: 2515 - protein, 9 aa, Artificial Sequence
  source: /note="Description of Artificial Sequence: Synthetic peptide"
QTWGTGILV

SEQ ID NO: 2516 - skipped

SEQ ID NO: 2517 - protein, 21 aa, Artificial Sequence
  source: /note="Description of Artificial Sequence: Synthetic peptide"
ARVEDWGYCSSTNCYSGAFDI

SEQ ID NO: 2518 - protein, 111 aa, Artificial Sequence
  source: /note="Description of Artificial Sequence: Synthetic polypeptide"
QSVLTQPPSVSEAPRQRVTISCSGSSSNIGNNAVNWYQQLPGKAPKLLIYYDDLLPSGVSDRFSGSKSGTSASLAISGLQSEDEADYYFAAWDDSLNGAWVFGGGTKLTVL

SEQ ID NO: 2519 - protein, 9 aa, Artificial Sequence
  source: /note="Description of Artificial Sequence: Synthetic peptide"
QQHNSSPLT

SEQ ID NO: 2520 - skipped

SEQ ID NO: 2521 - protein, 21 aa, Artificial Sequence
  source: /note="Description of Artificial Sequence: Synthetic peptide"
ARVEDWGYCSSTNCYSGAFDI

SEQ ID NO: 2522 - protein, 111 aa, Artificial Sequence
  source: /note="Description of Artificial Sequence: Synthetic polypeptide"
QSVLTQPPSVSEAPRQRVTISCSGSSSNIGNNAVNWYQQVPGKAPKLLIYYDDLLPSGVSDRFSGSKSGTSASLAISGLQSEDEADYYCAAWDDSLNGAWVFGGGTKLTVL

SEQ ID NO: 2523 - protein, 9 aa, Artificial Sequence
  source: /note="Description of Artificial Sequence: Synthetic peptide"
QQHNSSPLT

SEQ ID NO: 2524 - skipped

SEQ ID NO: 2525 - protein, 24 aa, Artificial Sequence
  source: /note="Description of Artificial Sequence: Synthetic peptide"
ARERPGGTYSNTWYTPTDTNWFDT

SEQ ID NO: 2526 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYFDSDRPSGIPERFSGSNSGNTATLTISRVEAGDEADYYCQVWDSSRDHVVFGGGTKLTVL

SEQ ID NO: 2527 - protein, 9 aa, Artificial Sequence
  source: /note="Description of Artificial Sequence: Synthetic peptide"
MQVLQIPYT

SEQ ID NO: 2528 - skipped

SEQ ID NO: 2529 - protein, 24 aa, Artificial Sequence
  source: /note="Description of Artificial Sequence: Synthetic peptide"
ARERPGGTYSNTWYTPTDTNWFDT

SEQ ID NO: 2530 - protein, 108 aa, Artificial Sequence; identical to SEQ ID NO: 2526
  source: /note="Description of Artificial Sequence: Synthetic polypeptide"

SEQ ID NO: 2531 - protein, 9 aa, Artificial Sequence
  source: /note="Description of Artificial Sequence: Synthetic peptide"
MQVLQVPYT

SEQ ID NO: 2532 - skipped

SEQ ID NO: 2533 - protein, 21 aa, Artificial Sequence
  source: /note="Description of Artificial Sequence: Synthetic peptide"
ARSFRDDPRIAVAGPADAFDI

SEQ ID NO: 2534 - protein, 107 aa, Artificial Sequence
  source: /note="Description of Artificial Sequence: Synthetic polypeptide"
DIQMTQSPSTLSASVGDRATITCRASQSISYWLAWYQQKPGKAPKLLIYKASSLESGVPSRFSGSGSGTEFTLTISSLQPDDSATYYCQQYNSYPYTFGQGTKLEIK

SEQ ID NO: 2535 - protein, 9 aa, Artificial Sequence
  source: /note="Description of Artificial Sequence: Synthetic peptide"
QQYDNLPQT

SEQ ID NO: 2536 - skipped

SEQ ID NO: 2537 - protein, 21 aa, Artificial Sequence
  source: /note="Description of Artificial Sequence: Synthetic peptide"
ARSFRDDPRIAVAGPADAFDI

SEQ ID NO: 2538 - protein, 107 aa, Artificial Sequence; identical to SEQ ID NO: 66
  source: /note="Description of Artificial Sequence: Synthetic polypeptide"

SEQ ID NO: 2539 - protein, 9 aa, Artificial Sequence
  source: /note="Description of Artificial Sequence: Synthetic peptide"
QQYDNLPQT

SEQ ID NO: 2540 - skipped

SEQ ID NO: 2541 - protein, 15 aa, Artificial Sequence
  source: /note="Description of Artificial Sequence: Synthetic peptide"
ARAIAVAGTSGEFDY

SEQ ID NO: 2542 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHVVFGGGTKLTVL

SEQ ID NO: 2543 - protein, 10 aa, Artificial Sequence
  source: /note="Description of Artificial Sequence: Synthetic peptide"
QSYDSSLYAV

SEQ ID NO: 2544 - skipped

SEQ ID NO: 2545 - protein, 12 aa, Artificial Sequence
  source: /note="Description of Artificial Sequence: Synthetic peptide"
ARSQGWLQLNDY

SEQ ID NO: 2546 - protein, 112 aa, Artificial Sequence
  source: /note="Description of Artificial Sequence: Synthetic polypeptide"
NFMLTQPHSVSESPGKTVTISCTGSSGSIASNYVQWYQQRPGSAPTTMIYEDNQRPSGVPDRFSGSIDSSSNSASLTISGLKTEDEADYYCQSYDSSTPNCVFGGGTKLTVL

SEQ ID NO: 2547 - protein, 10 aa, Artificial Sequence
  source: /note="Description of Artificial Sequence: Synthetic peptide"
QSYDSSLYAV

SEQ ID NO: 2548 - skipped

SEQ ID NO: 2549 - protein, 16 aa, Artificial Sequence
  source: /note="Description of Artificial Sequence: Synthetic peptide"
ARGHDYVWGSYRYHNV

SEQ ID NO: 2550 - protein, 110 aa, Artificial Sequence
  source: /note="Description of Artificial Sequence: Synthetic polypeptide"
  MOD_RES (109)..(109): Any amino acid
QSVLTQPASVSGSPGQSITISCTGTSSDVGGYNYVSWYQQHPGKAPKVMIYDVSNRPSGVSNRFSGSKSGNTASLTISGLQAEDEADYYCSSYTSSSTLLFGGGTKLTXL

SEQ ID NO: 2551 - protein, 10 aa, Artificial Sequence
  source: /note="Description of Artificial Sequence: Synthetic peptide"
NSYTSSSTRV

SEQ ID NO: 2552 - skipped

SEQ ID NO: 2553 - protein, 15 aa, Artificial Sequence
  source: /note="Description of Artificial Sequence: Synthetic peptide"
ARDLAFSMVRAPGDY

SEQ ID NO: 2554 - protein, 110 aa, Artificial Sequence; identical to SEQ ID NO: 144
  source: /note="Description of Artificial Sequence: Synthetic polypeptide"

SEQ ID NO: 2555 - protein, 10 aa, Artificial Sequence
  source: /note="Description of Artificial Sequence: Synthetic peptide"
NSYTSSSTRV

SEQ ID NO: 2556 - skipped

SEQ ID NO: 2557 - protein, 13 aa, Artificial Sequence
  source: /note="Description of Artificial Sequence: Synthetic peptide"
ARELIAVAGIFDY

SEQ ID NO: 2558 - protein, 105 aa, Artificial Sequence
  source: /note="Description of Artificial Sequence: Synthetic polypeptide"
SYVLTQPPSVSVAPGKTARITCGGNNIGSKNVHWYQQKPGQAPVLVIYYDSDRPSGIPERFSGSNSGNTATLTISRVEAGDEADYYCQVWDSSWVFGGGTKLTVL

SEQ ID NO: 2559 - protein, 12 aa, Artificial Sequence
  source: /note="Description of Artificial Sequence: Synthetic peptide"
AAWDDSLNGAWV

SEQ ID NO: 2560 - skipped

SEQ ID NO: 2561 - protein, 22 aa, Artificial Sequence
  source: /note="Description of Artificial Sequence: Synthetic peptide"
ARAPLFPTGVLAGDYYYYGMDV

SEQ ID NO: 2562 - protein, 110 aa, Artificial Sequence
  source: /note="Description of Artificial Sequence: Synthetic polypeptide"
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTLVFGGGTKLTVL

SEQ ID NO: 2563 - protein, 12 aa, Artificial Sequence
  source: /note="Description of Artificial Sequence: Synthetic peptide"
AAWDDSLNGAWV

SEQ ID NO: 2564 - skipped

SEQ ID NO: 2565 - protein, 18 aa, Artificial Sequence
  source: /note="Description of Artificial Sequence: Synthetic peptide"
ARYKGTTVNTNYYYGMDV

SEQ ID NO: 2566 - protein, 106 aa, Artificial Sequence
  source: /note="Description of Artificial Sequence: Synthetic polypeptide"
SYVLTQPPSVSVSPGQTASITCSGDKLGDKYACWYQQKAGQSPVLVIYQDSKRPSGIPERFSGSKSGNTATLTISGTQAMDEADYYCQAWDSSTVVFGGGTKLTVL

SEQ ID NO: 2567 - protein, 11 aa, Artificial Sequence
  source: /note="Description of Artificial Sequence: Synthetic peptide"
QVWDSSRDHVV

SEQ ID NO: 2568 - skipped

SEQ ID NO: 2569 - protein, 19 aa, Artificial Sequence
  source: /note="Description of Artificial Sequence: Synthetic peptide"
ARDPSPIIARPGMGYWFDP

SEQ ID NO: 2570 - protein, 111 aa, Artificial Sequence
  source: /note="Description of Artificial Sequence: Synthetic polypeptide"
QSVLTQPPSVSGAPGQRVTISCTGSSSNIGAGYDVHWYQHLPGTAPKLLIYGNNNRPSGVPDRFSGSRSGTSASLAITGLQAEDEADYYCQSYDSSLSAVVFGGGTKLTVL

SEQ ID NO: 2571 - protein, 11 aa, Artificial Sequence
  source: /note="Description of Artificial Sequence: Synthetic peptide"
QVWDSSRDHVV

SEQ ID NO: 2572 - skipped

SEQ ID NO: 2573 - protein, 16 aa, Artificial Sequence
  source: /note="Description of Artificial Sequence: Synthetic peptide"
ARDSSGYYYVSNWFDP

SEQ ID NO: 2574 - protein, 111 aa, Artificial Sequence
  source: /note="Description of Artificial Sequence: Synthetic polypeptide"
QSVLTQPPSVSGAPGQRVTISCTGSSSNIGAGYDVHWYQQLPGTAPNLLIYDNINRPSGVPDRFSGSKSGTSASLAITGLQAEDEADYYCQSYDSSLSGVVFGGGTKLTVL

SEQ ID NO: 2575 - protein, 9 aa, Artificial Sequence
  source: /note="Description of Artificial Sequence: Synthetic peptide"
QQYNSYPYT

SEQ ID NO: 2576 - skipped

SEQ ID NO: 2577 - protein, 14 aa, Artificial Sequence
  source: /note="Description of Artificial Sequence: Synthetic peptide"
ATYRSYLPLVQVDY

SEQ ID NO: 2578 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSKHAVFGGGTQLTVL

SEQ ID NO: 2579 - protein, 9 aa, Artificial Sequence
  source: /note="Description of Artificial Sequence: Synthetic peptide"
QQYNSYPYT

SEQ ID NO: 2580 - skipped

SEQ ID NO: 2581 - protein, 11 aa, Artificial Sequence
  source: /note="Description of Artificial Sequence: Synthetic peptide"
ARGQLLPFADY

SEQ ID NO: 2582 - protein, 111 aa, Artificial Sequence
  source: /note="Description of Artificial Sequence: Synthetic polypeptide"
NFMLTQPHSVSESPGKTVTISCAGSSGSIASNYVQWYQQRPGSAPTTVIYEDNQRPSGVPDRFSGSIDSSSNSASLTISGLKTEDEADYYCQSYDSSKSWVFGGGTKLTVL

SEQ ID NO: 2583 - protein, 12 aa, Artificial Sequence
  source: /note="Description of Artificial Sequence: Synthetic peptide"
AAWDDSLNGHVV

SEQ ID NO: 2584 - skipped

SEQ ID NO: 2585 - protein, 25 aa, Artificial Sequence
  source: /note="Description of Artificial Sequence: Synthetic peptide"
TRGSRGYYDRSGYYTPLDPYYGMDV

SEQ ID NO: 2586 - protein, 112 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL

SEQ ID NO: 2587 - protein, 11 aa, Artificial Sequence
  source: /note="Description of Artificial Sequence: Synthetic peptide"
QSYDSSTPNCV

SEQ ID NO: 2588 - skipped

SEQ ID NO: 2589 - protein, 14 aa, Artificial Sequence
  source: /note="Description of Artificial Sequence: Synthetic peptide"
AKEEVLPAVEYFQH

SEQ ID NO: 2590 - protein, 109 aa, Artificial Sequence
  source: /note="Description of Artificial Sequence: Synthetic polypeptide"
SYVLTQPPSVSVAPGKTARITCGGNNIGSKSVHWYQQKPGQAPVLVISYDSDRPSGIPERFSGSNSGNTATLTISRVEAGDAADYYCQVWDGSSDHHVVFGGGTKLTVL

SEQ ID NO: 2591 - protein, 10 aa, Artificial Sequence
  source: /note="Description of Artificial Sequence: Synthetic peptide"
SSYTSSSTLL

SEQ ID NO: 2592 - skipped

SEQ ID NO: 2593 - protein, 19 aa, Artificial Sequence
  source: /note="Description of Artificial Sequence: Synthetic peptide"
AKGGYYYYNSDSYQAEIDY

SEQ ID NO: 2594 - protein, 110 aa, Artificial Sequence
  source: /note="Description of Artificial Sequence: Synthetic polypeptide"
QSVLTQPPSVSAAPGQRVTISCSGSSSNIGNNYVSWYQQLPGTAPKLLIYENNKRPSGIPDRFSGSKSGTSATLGITGLQTGDEADYYCGTWDSSLSAFVFGTGTKVTVL

SEQ ID NO: 2595 - protein, 10 aa, Artificial Sequence
  source: /note="Description of Artificial Sequence: Synthetic peptide"
CSYAGSSTWV

SEQ ID NO: 2596 - skipped

SEQ ID NO: 2597 - protein, 17 aa, Artificial Sequence
  source: /note="Description of Artificial Sequence: Synthetic peptide"
AKDPLPFRDFFYYYMDV

SEQ ID NO: 2598 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL

SEQ ID NO: 2599 - protein, 8 aa, Artificial Sequence
  source: /note="Description of Artificial Sequence: Synthetic peptide"
QVWDSSWV

SEQ ID NO: 2600 - skipped

SEQ ID NO: 2601 - protein, 21 aa, Artificial Sequence
  source: /note="Description of Artificial Sequence: Synthetic peptide"
ARETQGGYYGSGSYYASPFDP

SEQ ID NO: 2602 - protein, 109 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVVFGGGTKLTVL

SEQ ID NO: 2603 - protein, 10 aa, Artificial Sequence
  source: /note="Description of Artificial Sequence: Synthetic peptide"
CSYAGSSTLV

SEQ ID NO: 2604 - skipped

SEQ ID NO: 2605 - protein, 11 aa, Artificial Sequence
  source: /note="Description of Artificial Sequence: Synthetic peptide"
ARDFYHNWFDP

SEQ ID NO: 2606 - protein, 112 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQWVVFGGGTKLTVL

SEQ ID NO: 2607 - protein, 9 aa, Artificial Sequence
  source: /note="Description of Artificial Sequence: Synthetic peptide"
QAWDSSTVV

SEQ ID NO: 2608 - skipped

SEQ ID NO: 2609 - protein, 17 aa, Artificial Sequence
  source: /note="Description of Artificial Sequence: Synthetic peptide"
ARDRGLRLGGPKYYFDY

SEQ ID NO: 2610 - protein, 109 aa, Artificial Sequence
  source: /note="Description of Artificial Sequence: Synthetic polypeptide"
QSVLTQPASVSGSPGQSITISCPGTSSDVGGYNYVSWYQQHPGKAPKLMIYDVSTRPSGVSNRFSGSKSGNTASLTISGLQAEDEADYYCSSYTSSSVVFGGGTKLTVL

SEQ ID NO: 2611 - protein, 11 aa, Artificial Sequence
  source: /note="Description of Artificial Sequence: Synthetic peptide"
QSYDSSLSAVV

SEQ ID NO: 2612 - skipped

SEQ ID NO: 2613 - protein, 14 aa, Artificial Sequence
  source: /note="Description of Artificial Sequence: Synthetic peptide"
ARDPQRDPADYFDY

SEQ ID NO: 2614 - protein, 105 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSDRPSGIPERFSGSNSGNTATLTISRVEAGDEADYYCQVWDSSRVFGGGTKLTVL

SEQ ID NO: 2615 - protein, 11 aa, Artificial Sequence
  source: /note="Description of Artificial Sequence: Synthetic peptide"
QSYDSSLSGVV

SEQ ID NO: 2616 - skipped

SEQ ID NO: 2617 - protein, 12 aa, Artificial Sequence
  source: /note="Description of Artificial Sequence: Synthetic peptide"
AIQLWLRGGYDY

SEQ ID NO: 2618 - protein, 111 aa, Artificial Sequence
  source: /note="Description of Artificial Sequence: Synthetic polypeptide"
QSVLTQPPSASGSPGQSVTISCTGTSSDVGGYNYVSWYQQHPGKAPKLMIYEVTKRPSGVPDRFSGSKSGNTASLTVSGLQAEDEADYYCSSYAGSNNYVVFGGGTKLTVL

SEQ ID NO: 2619 - protein, 10 aa, Artificial Sequence
  source: /note="Description of Artificial Sequence: Synthetic peptide"
QSYDSSKHAV

SEQ ID NO: 2620 - skipped

SEQ ID NO: 2621 - protein, 12 aa, Artificial Sequence
  source: /note="Description of Artificial Sequence: Synthetic peptide"
AVQLWLRGNFDY

SEQ ID NO: 2622 - protein, 111 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLAISGLKTEDEADYYCQSYDSSNHVVFGGGTKLTVL

SEQ ID NO: 2623 - protein, 10 aa, Artificial Sequence
  source: /note="Description of Artificial Sequence: Synthetic peptide"
QSYDSSKSWV

SEQ ID NO: 2624 - skipped

SEQ ID NO: 2625 - protein, 14 aa, Artificial Sequence
  source: /note="Description of Artificial Sequence: Synthetic peptide"
AKDDREGFGDYFDY

SEQ ID NO: 2626 - protein, 108 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDSVRPSGIPERFSGSNSGNTATLTISRVEAGDEADYYCQVWDSSSDHYVFGTGTKVTVL

SEQ ID NO: 2627 - protein, 12 aa, Artificial Sequence
  source: /note="Description of Artificial Sequence: Synthetic peptide"
QSYDSSLSGSYV

SEQ ID NO: 2628 - skipped

SEQ ID NO: 2629 - protein, 17 aa, Artificial Sequence
  source: /note="Description of Artificial Sequence: Synthetic peptide"
AKDSLVRRNFYYYYMDV

SEQ ID NO: 2630 - protein, 111 aa, Artificial Sequence
  source: /note="Description of Artificial Sequence: Synthetic polypeptide"
  MOD_RES (110)..(110): Any amino acid
QSVLTQPPSVSGAPGQRVTISCTGSSSNIGAGYDVHWYQQLPGTAPKLLIYGNSDRPSGVPDRFSGSKSGTSASLAITGLQAEDEADYYCQSYDSSLSGVVFGGGTKLTXL

SEQ ID NO: 2631 - protein, 12 aa, Artificial Sequence
  source: /note="Description of Artificial Sequence: Synthetic peptide"
QVWDGSSDHHVV

SEQ ID NO: 2632 - skipped

SEQ ID NO: 2633 - protein, 18 aa, Artificial Sequence
  source: /note="Description of Artificial Sequence: Synthetic peptide"
AGMYYDILTGYSEGAFDI

SEQ ID NO: 2634 - protein, 110 aa, Artificial Sequence
  source: /note="Description of Artificial Sequence: Synthetic polypeptide"
QSVLTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 2635 - protein, 11 aa, Artificial Sequence
  source: /note="Description of Artificial Sequence: Synthetic peptide"
GTWDSSLSAFV

SEQ ID NO: 2636 - skipped

SEQ ID NO: 2637 - protein, 15 aa, Artificial Sequence
  source: /note="Description of Artificial Sequence: Synthetic peptide"
AGGTNPQWLDSTFDY

SEQ ID NO: 2638 - protein, 110 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTYVFGTGTKVTVL

SEQ ID NO: 2639 - protein, 11 aa, Artificial Sequence
  source: /note="Description of Artificial Sequence: Synthetic peptide"
SSYTSSSTLGV

SEQ ID NO: 2640 - skipped

SEQ ID NO: 2641 - protein, 15 aa, Artificial Sequence
  source: /note="Description of Artificial Sequence: Synthetic peptide"
ASAPYLNWNDWIFDY

SEQ ID NO: 2642 - protein, 110 aa, Artificial Sequence
  source: /note="Description of Artificial Sequence: Synthetic polypeptide"
QSVLTQPASVSGSPGQSITISCTGTSSDVGGYNYVSWYQQHPGEAPKLMIHDVSNRPSGVSNRFSGSKSGNTASLTISGLQAEDEADYYCSSYTSSSTLVFGGGTKLTVL

SEQ ID NO: 2643 - protein, 12 aa, Artificial Sequence
  source: /note="Description of Artificial Sequence: Synthetic peptide"
QVWDSSSDHPVV

SEQ ID NO: 2644 - skipped

SEQ ID NO: 2645 - protein, 12 aa, Artificial Sequence
  source: /note="Description of Artificial Sequence: Synthetic peptide"
ARLQWLRGAFDI

SEQ ID NO: 2646 - protein, 110 aa, Artificial Sequence; identical to SEQ ID NO: 96
  source: /note="Description of Artificial Sequence: Synthetic polypeptide"

SEQ ID NO: 2647 - protein, 11 aa, Artificial Sequence
  source: /note="Description of Artificial Sequence: Synthetic peptide"
QSYDSSNQWVV

SEQ ID NO: 2648 - skipped

SEQ ID NO: 2649 - protein, 16 aa, Artificial Sequence
  source: /note="Description of Artificial Sequence: Synthetic peptide"
ARYGWGYDSSGYYFDY

SEQ ID NO: 2650 - protein, 110 aa, Artificial Sequence
  source: /note="Description of Artificial Sequence: Synthetic polypeptide"
QSVLTQPASVSGSPGQSITISCTGTSSDVGSYNLVSWYQEHPGKAPKLMIYEGSKRPSGVSNRFSGSKSGNTASLTISGLQAEDEADYYCCSYAGSSTWVFGGGTKLTVL

SEQ ID NO: 2651 - protein, 9 aa, Artificial Sequence
  source: /note="Description of Artificial Sequence: Synthetic peptide"
SSYTSSSVV

SEQ ID NO: 2652 - skipped

SEQ ID NO: 2653 - protein, 12 aa, Artificial Sequence
  source: /note="Description of Artificial Sequence: Synthetic peptide"
ARATTPFSGVDY

SEQ ID NO: 2654 - protein, 110 aa, Artificial Sequence
  source: /note="Description of Artificial Sequence: Synthetic polypeptide"
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDTSNWVFGGGTKLTVL

SEQ ID NO: 2655 - protein, 8 aa, Artificial Sequence
  source: /note="Description of Artificial Sequence: Synthetic peptide"
QVWDSSRV

SEQ ID NO: 2656 - skipped

SEQ ID NO: 2657 - protein, 14 aa, Artificial Sequence
  source: /note="Description of Artificial Sequence: Synthetic peptide"
ARILRGVAENWFDP

SEQ ID NO: 2658 - protein, 109 aa, Artificial Sequence
  source: /note="Description of Artificial Sequence: Synthetic polypeptide"
SYVLTQPPSVSVAPGKTARITCGGNNIGSKSVHWYQQKPGQAPVLVIYYDTDRPSGIPERFSGSNSGNTATLTISRVEAGDEADYYCQVWDNNSDHRGVFGGGTRLTVL

SEQ ID NO: 2659 - protein, 11 aa, Artificial Sequence
  source: /note="Description of Artificial Sequence: Synthetic peptide"
SSYAGSNNYVV

SEQ ID NO: 2660 - skipped

SEQ ID NO: 2661 - protein, 19 aa, Artificial Sequence
  source: /note="Description of Artificial Sequence: Synthetic peptide"
ATRGGYYDSSGYYALAFDI

SEQ ID NO: 2662 - protein, 111 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVWVFGGGTKLTVL

SEQ ID NO: 2663 - protein, 10 aa, Artificial Sequence
  source: /note="Description of Artificial Sequence: Synthetic peptide"
QSYDSSNHVV

SEQ ID NO: 2664 - skipped

SEQ ID NO: 2665 - protein, 19 aa, Artificial Sequence
  source: /note="Description of Artificial Sequence: Synthetic peptide"
ATETNSETTDMFTGYSFDP

SEQ ID NO: 2666 - protein, 110 aa, Artificial Sequence
  source: /note="Description of Artificial Sequence: Synthetic polypeptide"
QSVLTQPPSASGTPGQRVTIACSGSSSNIGSSPVKWYKQLPGTGPKLLIYSSNQRPSGVPDRFSGSKSGTSASLAISGLQSEDEADYYCAAWDDSLSGYVFGTGTKVTVL

SEQ ID NO: 2667 - protein, 11 aa, Artificial Sequence
  source: /note="Description of Artificial Sequence: Synthetic peptide"
QVWDSSSDHYV

SEQ ID NO: 2668 - skipped

SEQ ID NO: 2669 - protein, 16 aa, Artificial Sequence
  source: /note="Description of Artificial Sequence: Synthetic peptide"
ARGGPPGGVKLELTDY

SEQ ID NO: 2670 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPQLLIYNNYQRPSGVPDRFSGSKSGTSASLAISGLQSEDEADYYCAAWDDSLNGPVVFGGGTKLTVL

SEQ ID NO: 2671 - protein, 11 aa, Artificial Sequence
  source: /note="Description of Artificial Sequence: Synthetic peptide"
QSYDSSLSGVV

SEQ ID NO: 2672 - skipped

SEQ ID NO: 2673 - protein, 18 aa, Artificial Sequence
  source: /note="Description of Artificial Sequence: Synthetic peptide"
ARLHPTYYDILTGYYIDY

SEQ ID NO: 2674 - protein, 109 aa, Artificial Sequence
  source: /note="Description of Artificial Sequence: Synthetic polypeptide"
QSALTQPASVSGSPGQSITISCTGTSSDVGSYNLVSWYQQHPGKAPKLMIYEGSKRPSGVSNRFSGSKSGNTASLTISGLQAEDEADYYCCLYAFSSIVFGGGTKLTVL

SEQ ID NO: 2675 - protein, 10 aa, Artificial Sequence
  source: /note="Description of Artificial Sequence: Synthetic peptide"
CSYAGSSTWV

SEQ ID NO: 2676 - skipped

SEQ ID NO: 2677 - protein, 13 aa, Artificial Sequence
  source: /note="Description of Artificial Sequence: Synthetic peptide"
ARRPSSYSGWFDP

SEQ ID NO: 2678 - protein, 110 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYNNNQRPSGVPDRFSGSKSGTSASLAISGLQSEDEADYYCAAWDDSLNGLVFGGGTKLTVL

SEQ ID NO: 2679 - protein, 10 aa, Artificial Sequence
  source: /note="Description of Artificial Sequence: Synthetic peptide"
SSYTSSSTYV

SEQ ID NO: 2680 - skipped

SEQ ID NO: 2681 - protein, 21 aa, Artificial Sequence
  source: /note="Description of Artificial Sequence: Synthetic peptide"
AREPQINPYYDILTGYRAFDY

SEQ ID NO: 2682 - protein, 107 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGQGTRLEIK

SEQ ID NO: 2683 - protein, 10 aa, Artificial Sequence
  source: /note="Description of Artificial Sequence: Synthetic peptide"
SSYTSSSTLV

SEQ ID NO: 2684 - skipped

SEQ ID NO: 2685 - protein, 25 aa, Artificial Sequence
  source: /note="Description of Artificial Sequence: Synthetic peptide"
ARGPRSPSDWCSGGSCYDDQNWFDP

SEQ ID NO: 2686 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYSASSLQSGVPSRFSGSGSGTDFTLTISSLQPEDFATYYCQQSYSTLITFGQGTRLEIK

SEQ ID NO: 2687 - protein, 9 aa, Artificial Sequence
  source: /note="Description of Artificial Sequence: Synthetic peptide"
QSYDSSNLV

SEQ ID NO: 2688 - skipped

SEQ ID NO: 2689 - protein, 17 aa, Artificial Sequence
  source: /note="Description of Artificial Sequence: Synthetic peptide"
ARDFELWFGELRGWFDP

SEQ ID NO: 2690 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPTLLIYGASTRATGIPARFSGSGSGTEFTLTISSLQSEDFAVYYCQQYNNWPPITFGQGTRLEIK

SEQ ID NO: 2691 - protein, 10 aa, Artificial Sequence
  source: /note="Description of Artificial Sequence: Synthetic peptide"
CSYAGSSTWV

SEQ ID NO: 2692 - skipped

SEQ ID NO: 2693 - protein, 15 aa, Artificial Sequence
  source: /note="Description of Artificial Sequence: Synthetic peptide"
ASFHVAYGDYIPFDY

SEQ ID NO: 2694 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEREDFAVYYCQQYGRSPTWTFGQGTKVEIK

SEQ ID NO: 2695 - protein, 9 aa, Artificial Sequence
  source: /note="Description of Artificial Sequence: Synthetic peptide"
QSYDTSNWV

SEQ ID NO: 2696 - skipped

SEQ ID NO: 2697 - protein, 19 aa, Artificial Sequence
  source: /note="Description of Artificial Sequence: Synthetic peptide"
ARAGLLTKNIVATIGCFDP

SEQ ID NO: 2698 - protein, 113 aa, Artificial Sequence; identical to SEQ ID NO: 1275
  source: /note="Description of Artificial Sequence: Synthetic polypeptide"
  MOD_RES (15)..(15): Any amino acid

SEQ ID NO: 2699 - protein, 12 aa, Artificial Sequence
  source: /note="Description of Artificial Sequence: Synthetic peptide"
QVWDNNSDHRGV

SEQ ID NO: 2700 - skipped

SEQ ID NO: 2701 - protein, 20 aa, Artificial Sequence
  source: /note="Description of Artificial Sequence: Synthetic peptide"
ARGGRYCSSTSCYSHVGFDP

SEQ ID NO: 2702 - protein, 107 aa, Artificial Sequence
  source: /note="Description of Artificial Sequence: Synthetic polypeptide"
DIQLTQSPSFLSASVGDRVTITCRASQGISSYLAWFQQKPGKAPKLLIYAASTLQTGVPSRFSGSGSGTEFTLTISSLQPEDFATYYCQQLNSYPITFGQGTRLEIK

SEQ ID NO: 2703 - protein, 11 aa, Artificial Sequence
  source: /note="Description of Artificial Sequence: Synthetic peptide"
SSYTSSSTVWV

SEQ ID NO: 2704 - skipped

SEQ ID NO: 2705 - protein, 16 aa, Artificial Sequence
  source: /note="Description of Artificial Sequence: Synthetic peptide"
ARVRYDSSGYFWSLDY

SEQ ID NO: 2706 - protein, 108 aa, Artificial Sequence
  source: /note="Description of Artificial Sequence: Synthetic polypeptide"
DIQMTQSPSSLSASVGDRVTITCRASQSISRYLNWYQQKPGKAPKLLIYAASSLQSGVPSRFSGSGSGTDFTLTISGLQPEDFATYYCQQSYSTPQYTFGQGTKLEIK

SEQ ID NO: 2707 - protein, 11 aa, Artificial Sequence
  source: /note="Description of Artificial Sequence: Synthetic peptide"
AAWDDSLSGYV

SEQ ID NO: 2708 - skipped

SEQ ID NO: 2709 - protein, 22 aa, Artificial Sequence
  source: /note="Description of Artificial Sequence: Synthetic peptide"
ARGVSGVVRGVIRSFYYYGLDV

SEQ ID NO: 2710 - protein, 108 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYITPGWTFGQGTKVEIK

SEQ ID NO: 2711 - protein, 12 aa, Artificial Sequence
  source: /note="Description of Artificial Sequence: Synthetic peptide"
AAWDDSLNGPVV

SEQ ID NO: 2712 - skipped

SEQ ID NO: 2713 - protein, 20 aa, Artificial Sequence
  source: /note="Description of Artificial Sequence: Synthetic peptide"
VETNLWFGEDNYYYYYGMDV

SEQ ID NO: 2714 - protein, 109 aa, Artificial Sequence
  source: /note="Description of Artificial Sequence: Synthetic polypeptide"
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPPWTFGQGTKVEIK

SEQ ID NO: 2715 - protein, 9 aa, Artificial Sequence
  source: /note="Description of Artificial Sequence: Synthetic peptide"
CLYAFSSIV

SEQ ID NO: 2716 - skipped

SEQ ID NO: 2717 - protein, 16 aa, Artificial Sequence
  source: /note="Description of Artificial Sequence: Synthetic peptide"
ATGGGSYFSPRIYFDY

SEQ ID NO: 2718 - protein, 108 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPPYTFGQGTKLEIK

SEQ ID NO: 2719 - protein, 11 aa, Artificial Sequence
  source: /note="Description of Artificial Sequence: Synthetic peptide"
AAWDDSLNGLV

SEQ ID NO: 2720 - skipped

SEQ ID NO: 2721 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDWGEYYFDYWGQGTLVTVSS

SEQ ID NO: 2722 - protein, 107 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNVPLTFGPGTKVDIK

SEQ ID NO: 2723 - protein, 8 aa, Artificial Sequence
  source: /note="Description of Artificial Sequence: Synthetic peptide"
QQYGSSLT

SEQ ID NO: 2724 - skipped

SEQ ID NO: 2725 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSVIYSGGSTYYADSVKGRFTISRDNSKNTLYLQMNSLRVEDTAVYYCARDYGDYYFDYWGQGTLVTVSS

SEQ ID NO: 2726 - protein, 107 aa, Artificial Sequence
  source: /note="Description of Artificial Sequence: Synthetic polypeptide"
DIQMTQSPSTLSASVGDRVTITCRASQSISSWLAWYQQKPGKAPKLLISEASSLESGVPSRFSGSGSGTEFTLTISSLQPDDFATYYCQQYNSYSYTFGQGTKLEIK

SEQ ID NO: 2727 - protein, 9 aa, Artificial Sequence
  source: /note="Description of Artificial Sequence: Synthetic peptide"
QQSYSTLIT

SEQ ID NO: 2728 - skipped

SEQ ID NO: 2729 - protein, 117 aa, Artificial Sequence; identical to SEQ ID NO: 2721
  source: /note="Description of Artificial Sequence: Synthetic polypeptide"

SEQ ID NO: 2730 - protein, 106 aa, Artificial Sequence
  source: /note="Description of Artificial Sequence: Synthetic polypeptide"
DIQMTQSPSTLSASVGDRVTITCRASQSISSWLAWYQQKPGKAPKLLIYEASSLESGVPSRFSGSGSGTEFTLTISSLQPDDFATYYCQQYNSYSTFGPGTKVDIK

SEQ ID NO: 2731 - protein, 10 aa, Artificial Sequence
  source: /note="Description of Artificial Sequence: Synthetic peptide"
QQYNNWPPIT

SEQ ID NO: 2732 - skipped

SEQ ID NO: 2733 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSVIYSGGSTFYADSVKGRFTISRDNSKNTLYLQMNSLRAEDTAVYYCARDYGDYYFDYWGQGTLVTVSS

SEQ ID NO: 2734 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVFYCQQYGTSPSTFGQGTKVESK

SEQ ID NO: 2735 - protein, 10 aa, Artificial Sequence
  source: /note="Description of Artificial Sequence: Synthetic peptide"
QQYGRSPTWT

SEQ ID NO: 2736 - skipped

SEQ ID NO: 2737 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSVIYSGGSTFYTDSVKGRFTISRDNSKNTLYLQMNSLRAEDTAVYYCVRDYGDFYFDYWGQGTLVTVSS

SEQ ID NO: 2738 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGTGSGTEFTLTISSLQSEDFAVYYCQQYNNWPLTFGGGTKVEIK

SEQ ID NO: 2739 - protein, 9 aa, Artificial Sequence
  source: /note="Description of Artificial Sequence: Synthetic peptide"
QQYYSTPLT

SEQ ID NO: 2740 - skipped

SEQ ID NO: 2741 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKASLKSRVTISVGMSRNQFSLKVTSLTAADTAVYYCARKPLLYSDFSPGAFDIWGQGTMIVVSS

SEQ ID NO: 2742 - protein, 107 aa, Artificial Sequence
  source: /note="Description of Artificial Sequence: Synthetic polypeptide"
DIQMTQSPSSLSASVGDRVTITCQASQDINNYLNWYQQKPGKAPKVLIYDASNLETGVPSRFSGSGSGTDFTFTISSLQPEDFATYYCQQYDNLPLAFGGGTKVEIK

SEQ ID NO: 2743 - protein, 9 aa, Artificial Sequence
  source: /note="Description of Artificial Sequence: Synthetic peptide"
QQLNSYPIT

SEQ ID NO: 2744 - skipped

SEQ ID NO: 2745 - protein, 123 aa, Artificial Sequence; identical to SEQ ID NO: 55
  source: /note="Description of Artificial Sequence: Synthetic polypeptide"

SEQ ID NO: 2746 - protein, 108 aa, Artificial Sequence
  source: /note="Description of Artificial Sequence: Synthetic polypeptide"
DIQMTQSPSSLSASVRDRVTITCRASQSISSYLNWYQQKPGKAPKLLIYAASSLQSGVPSRFSGSGSGTDFTLTISSLQPEDLATYYCQQSYSTPPWTFGQGTKVEIK

SEQ ID NO: 2747 - protein, 10 aa, Artificial Sequence
  source: /note="Description of Artificial Sequence: Synthetic peptide"
QQSYSTPQYT

SEQ ID NO: 2748 - skipped

SEQ ID NO: 2749 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKPSLKSRVTISVDMSRNQFSLIMTSVTAADTAVYYCARKTLLFSDFSPGAFDIWGQGTMVVVSS

SEQ ID NO: 2750 - protein, 108 aa, Artificial Sequence
  source: /note="Description of Artificial Sequence: Synthetic polypeptide"
DIQMTQSPSSLSASVGDRVTITCRASQSISRYLNWYQQKPGKAPNLLIYAASSLQSGVPSRFSGSGSGTDFTLIISSLQPEDFATYYCQQSYSTLALTFGGGTKVEIK

SEQ ID NO: 2751 - protein, 10 aa, Artificial Sequence
  source: /note="Description of Artificial Sequence: Synthetic peptide"
QQSYITPGWT

SEQ ID NO: 2752 - skipped

SEQ ID NO: 2753 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTDYKPSLKSRVTISVDMSRNQFSLKVTSVTAADTAVYYCARKPLLHSDLSPGAFDIWGQGTMVAVSS

SEQ ID NO: 2754 - protein, 109 aa, Artificial Sequence; identical to SEQ ID NO: 92
  source: /note="Description of Artificial Sequence: Synthetic polypeptide"

SEQ ID NO: 2755 - protein, 10 aa, Artificial Sequence
  source: /note="Description of Artificial Sequence: Synthetic peptide"
QQYGSSPPWT

SEQ ID NO: 2756 - skipped

SEQ ID NO: 2757 - protein, 123 aa, Artificial Sequence
  source: /note="Description of Artificial Sequence: Synthetic polypeptide"
QVQLQQWGAGLLKPSETLSLTCAVSGGSLSGFYWTWIRQPPGKGLEWIGETNHFGSTGYKPSLKSRVTISVDMSRNQFSLKVTSVTAADTAVYYCARKPLLYSDFSPGAFDIWGQGTMVAVSS

SEQ ID NO: 2758 - protein, 109 aa, Artificial Sequence
  source: /note="Description of Artificial Sequence: Synthetic polypeptide"
EIVLTQSPATLSLSPGERATLSCRASQSFSSYLAWYQQKPGQAPRLLIYDASNRATGIPARFSGSGSGTDFTLTISSLEPEDFAFYYCQQRSNWPQGFTFGPGTKVDIK

SEQ ID NO: 2759 - protein, 10 aa, Artificial Sequence
  source: /note="Description of Artificial Sequence: Synthetic peptide"
QQYDNLPPYT

SEQ ID NO: 2760 - skipped

SEQ ID NO: 2761 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMHSLRAEDTAVYYCARGEGWDLPYDYWGQGTLVTVSS

SEQ ID NO: 2762 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLHSGVPSRFSGSGSGTDFTLTISSLQPEDFATYYCQQSYSAPWTFGQGTKVEIK

SEQ ID NO: 2763 - protein, 9 aa, Artificial Sequence
  source: /note="Description of Artificial Sequence: Synthetic peptide"
QQYDNVPLT

SEQ ID NO: 2764 - skipped

SEQ ID NO: 2765 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYTGGSTFYADSVKGRFTISRDNSKNTLYLQMNSLRAEDTAMYYCARGEGWDLPYDYWGQGTLVTVSS

SEQ ID NO: 2766 - protein, 108 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSGSGTDFTFTISSLQPEDIATYYCQQYDNLPRVTFGPGTKVDIK

SEQ ID NO: 2767 - protein, 9 aa, Artificial Sequence
  source: /note="Description of Artificial Sequence: Synthetic peptide"
QQYNSYSYT

SEQ ID NO: 2768 - skipped

SEQ ID NO: 2769 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGWELPYDYWGQGTLVTVSS

SEQ ID NO: 2770 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPGFGQGTKVEIK

SEQ ID NO: 2771 - protein, 8 aa, Artificial Sequence
  source: /note="Description of Artificial Sequence: Synthetic peptide"
QQYNSYST

SEQ ID NO: 2772 - skipped

SEQ ID NO: 2773 - protein, 122 aa, Artificial Sequence; identical to SEQ ID NO: 61
  source: /note="Description of Artificial Sequence: Synthetic polypeptide"

SEQ ID NO: 2774 - protein, 107 aa, Artificial Sequence; identical to SEQ ID NO: 90
  source: /note="Description of Artificial Sequence: Synthetic polypeptide"

SEQ ID NO: 2775 - protein, 9 aa, Artificial Sequence
  source: /note="Description of Artificial Sequence: Synthetic peptide"
QQYGTSPST

SEQ ID NO: 2776 - skipped

SEQ ID NO: 2777 - protein, 122 aa, Artificial Sequence; identical to SEQ ID NO: 61
  source: /note="Description of Artificial Sequence: Synthetic polypeptide"

SEQ ID NO: 2778 - protein, 107 aa, Artificial Sequence
  source: /note="Description of Artificial Sequence: Synthetic polypeptide"
DIQMTQSPSSLSASVGDRVTITCRASQDINNYLAWYQQKPGKVPKLLIYAASTLQSGVPSRFSGSGSGTDFTLTISSLQPEDVATFYCQKYNSAPLTFGGGTKVEIK

SEQ ID NO: 2779 - protein, 9 aa, Artificial Sequence
  source: /note="Description of Artificial Sequence: Synthetic peptide"
QQYNNWPLT

SEQ ID NO: 2780 - skipped

SEQ ID NO: 2781 - protein, 125 aa, Artificial Sequence
  source: /note="Description of Artificial Sequence: Synthetic polypeptide"
QVQLVQSGAEVKKPGASVKVSCKASGYTFTDYYIHWVRQAPGQGLEWMGWINPNSGGTNYAQKFQGRVTMTRDTSISTAYMELSRLRSDDTAVYYCARDVIVSMVRGVIFRMDVWGQGTTVTVSS

SEQ ID NO: 2782 - protein, 106 aa, Artificial Sequence
  source: /note="Description of Artificial Sequence: Synthetic polypeptide"
DIQMTQSPSTLSASVGDRVTITCRASQSISSWLAWYQQKPGKAPKLLIYKASSLESGVPSRFSGSGSGTEFTLTISSLQPDDFATYYCQQYNSYGTFGQGTKVEIK

SEQ ID NO: 2783 - protein, 9 aa, Artificial Sequence
  source: /note="Description of Artificial Sequence: Synthetic peptide"
QQYDNLPLA

SEQ ID NO: 2784 - skipped

SEQ ID NO: 2785 - protein, 125 aa, Artificial Sequence; identical to SEQ ID NO: 97
  source: /note="Description of Artificial Sequence: Synthetic polypeptide"

SEQ ID NO: 2786 - protein, 107 aa, Artificial Sequence; identical to SEQ ID NO: 88
  source: /note="Description of Artificial Sequence: Synthetic polypeptide"

SEQ ID NO: 2787 - protein, 10 aa, Artificial Sequence
  source: /note="Description of Artificial Sequence: Synthetic peptide"
QQSYSTPPWT

SEQ ID NO: 2788 - skipped

SEQ ID NO: 2789 - protein, 127 aa, Artificial Sequence; identical to SEQ ID NO: 81
  source: /note="Description of Artificial Sequence: Synthetic polypeptide"

SEQ ID NO: 2790 - protein, 108 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQQLDSYPPGTFGPGTKVDIK

SEQ ID NO: 2791 - protein, 10 aa, Artificial Sequence
  source: /note="Description of Artificial Sequence: Synthetic peptide"
QQSYSTLALT

SEQ ID NO: 2792 - skipped

SEQ ID NO: 2793 - protein, 127 aa, Artificial Sequence; identical to SEQ ID NO: 81
  source: /note="Description of Artificial Sequence: Synthetic polypeptide"

SEQ ID NO: 2794 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYYNWPRTFGQGTKVEIK

SEQ ID NO: 2795 - protein, 11 aa, Artificial Sequence
  source: /note="Description of Artificial Sequence: Synthetic peptide"
QQRNNWPPEWT

SEQ ID NO: 2796 - skipped

SEQ ID NO: 2797 - protein, 123 aa, Artificial Sequence
  source: /note="Description of Artificial Sequence: Synthetic polypeptide"
QMQLVQSGPEVKKPGTSVKVSCKASGFTFTSSAVQWVRQARGQRLEWIGWIVVGSGNTNYVQKFQERVTITRDMSTSTAYMELSSLRSEDTAVYYCAAPHCSSTSCFDAFDIWGQGTMVTVSS

SEQ ID NO: 2798 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTRLEIK

SEQ ID NO: 2799 - protein, 11 aa, Artificial Sequence
  source: /note="Description of Artificial Sequence: Synthetic peptide"
QQRSNWPQGFT

SEQ ID NO: 2800 - skipped

SEQ ID NO: 2801 - protein, 123 aa, Artificial Sequence
  source: /note="Description of Artificial Sequence: Synthetic polypeptide"
QMQLVQSGPEVKKPGTSVKVSCKASGFTFTSSAVQWVRQARGQRLEWIGWIVVGSGNTNYAQKFQERVTITRDMSTSTAYMELSSLRSEDTAVYYCAAPYCSGGSCSDAFDIWGQGTMVTVSS

SEQ ID NO: 2802 - protein, 107 aa, Artificial Sequence
  source: /note="Description of Artificial Sequence: Synthetic polypeptide"
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPKTFGQGTKVEIK

SEQ ID NO: 2803 - protein, 9 aa, Artificial Sequence
  source: /note="Description of Artificial Sequence: Synthetic peptide"
QQSYSAPWT

SEQ ID NO: 2804 - skipped

SEQ ID NO: 2805 - protein, 127 aa, Artificial Sequence
  source: /note="Description of Artificial Sequence: Synthetic polypeptide"
QVQLVESGGGLVQPGRSLRLSCAASGFTFSTYAMHWVRQAPGKGLKWVAVISYDGGNKYYADSVKGRFTISRDNSKNTLYLQMNSLRAEDTAVYYCARDPIWFGELLSPPFVHFDYWGQGTLVTVSS

SEQ ID NO: 2806 - protein, 107 aa, Artificial Sequence
  source: /note="Description of Artificial Sequence: Synthetic polypeptide"
DIQLTQSPSFLSASVGDRVTITCRASQGISSYLAWYQQKPGKAPKLLIYAASTLQSGVPSRFSGSGSGTEFTLTISSLQPEDFATYYCQLLNSYPYTFGQGTKLEIK

SEQ ID NO: 2807 - protein, 10 aa, Artificial Sequence
  source: /note="Description of Artificial Sequence: Synthetic peptide"
QQYDNLPRVT

SEQ ID NO: 2808 - skipped

SEQ ID NO: 2809 - protein, 127 aa, Artificial Sequence; identical to SEQ ID NO: 77
  source: /note="Description of Artificial Sequence: Synthetic polypeptide"

SEQ ID NO: 2810 - protein, 108 aa, Artificial Sequence
  source: /note="Description of Artificial Sequence: Synthetic polypeptide"
DIQMTQSPSSLSASVGDRVTITCRASQSISSYLYWYQQKPGKAPKLLIYAASSLQSGVPSRFSGSGSGTDFTLTISSLQPEDFATYYCQQSYSTPPFTFGPGTKVDIK

SEQ ID NO: 2811 - protein, 9 aa, Artificial Sequence
  source: /note="Description of Artificial Sequence: Synthetic peptide"
QQLNSYPPG

SEQ ID NO: 2812 - skipped

SEQ ID NO: 2813 - protein, 121 aa, Artificial Sequence; identical to SEQ ID NO: 67
  source: /note="Description of Artificial Sequence: Synthetic polypeptide"

SEQ ID NO: 2814 - protein, 108 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGGGSGTDFTLTISSLEPEDFAVYYCQQRSNWPPLTFGQGTKVEIK

SEQ ID NO: 2815 - protein, 9 aa, Artificial Sequence
  source: /note="Description of Artificial Sequence: Synthetic peptide"
QQLNSYPPA

SEQ ID NO: 2816 - skipped

SEQ ID NO: 2817 - protein, 121 aa, Artificial Sequence
  source: /note="Description of Artificial Sequence: Synthetic polypeptide"
QVQLVESGGGVVQPGRSLRLSCAASGFTFSRHAMHWVRQAPGKGLEWVAVISYDGSNKYYADSVKGRFTISRDNSKNTLYLQMNSLRAEDTAVYYCAREDYYDSSGSFDYWGQGTLVTVSS

SEQ ID NO: 2818 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYNNWLSLTFGGGTKVEIK

SEQ ID NO: 2819 - protein, 9 aa, Artificial Sequence
  source: /note="Description of Artificial Sequence: Synthetic peptide"
QKYNSAPLT

SEQ ID NO: 2820 - skipped

SEQ ID NO: 2821 - protein, 127 aa, Artificial Sequence
  source: /note="Description of Artificial Sequence: Synthetic polypeptide"
  MOD_RES (58)..(58): Any amino acid
QVQLVESGGGVVQPGRSLRLSCAASGFTFSNYAMHWVRQAPGKGLEWVAVISYDGSNXYYADSVKGRFTISRDNSKNTLYLQMNSLRAEDTAIYYCASGYTGYDYFVRGDYYGLDVWGQGTTVTVSS

SEQ ID NO: 2822 - protein, 112 aa, Artificial Sequence
  source: /note="Description of Artificial Sequence: Synthetic polypeptide"
DIVMTQSPLSLPVTPGEPASISCRSSESLLHSNGYNYLDWYLQKPGQSPQLLIYLGSNRASGVPDRFSGSGSGTDFTLKISRVEAEDVGVYYCMQALQTPRTFGQGTKLEIK

SEQ ID NO: 2823 - protein, 8 aa, Artificial Sequence
  source: /note="Description of Artificial Sequence: Synthetic peptide"
QQYNSYGT

SEQ ID NO: 2824 - skipped

SEQ ID NO: 2825 - protein, 127 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGYTGYDYFVGGDYYGMDVWGQGTTVTVSS

SEQ ID NO: 2826 - protein, 106 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASNLETGVPSRFSGSKSGTDFTFTISSLQPEDIATYYCQQYDNLPYTFGQGTKVEI

SEQ ID NO: 2827 - protein, 9 aa, Artificial Sequence
  source: /note="Description of Artificial Sequence: Synthetic peptide"
QQLNSDSYT

SEQ ID NO: 2828 - skipped

SEQ ID NO: 2829 - protein, 125 aa, Artificial Sequence; identical to SEQ ID NO: 69
  source: /note="Description of Artificial Sequence: Synthetic polypeptide"

SEQ ID NO: 2830 - protein, 105 aa, Artificial Sequence
  source: /note="Description of Artificial Sequence: Synthetic polypeptide"
DIQMTQSPSSLSASVGDRVTITCQASQDISNYLNWYQQKPGKAPKLLIYDASYLETGVPSRFTGSASGTDFTFTISSLQPEDIATYYCQQYDNVPLFGPGTKVDI

SEQ ID NO: 2831 - protein, 10 aa, Artificial Sequence
  source: /note="Description of Artificial Sequence: Synthetic peptide"
QQLDSYPPGT

SEQ ID NO: 2832 - skipped

SEQ ID NO: 2833 - protein, 125 aa, Artificial Sequence; identical to SEQ ID NO: 69
  source: /note="Description of Artificial Sequence: Synthetic polypeptide"

SEQ ID NO: 2834 - protein, 112 aa, Artificial Sequence
  source: /note="Description of Artificial Sequence: Synthetic polypeptide"
DVVMTQSPLSLPVTLGQPASISCRSSQSLVYSDGNTYLNWFQQRPGQSPRRLIYQVSNRDSGVPDRFSGSGSGTDFTLKISRVEAEDVGVYYCMQGTHWLWTFGQGTKVEIK

SEQ ID NO: 2835 - protein, 9 aa, Artificial Sequence
  source: /note="Description of Artificial Sequence: Synthetic peptide"
QQYYNWPRT

SEQ ID NO: 2836 - skipped

SEQ ID NO: 2837 - protein, 120 aa, Artificial Sequence
  source: /note="Description of Artificial Sequence: Synthetic polypeptide"
EVQLVESGGGLIKPGRSLRLSCTASGFTFGDYAMTWFRQAPGKGLEWVGFIRSKAYGGTTGYAASVKYRFTISRDDSKSIAYLQMDSLKTEDTAVYYCTRWDGWSQHDYWGQGTLVTVSS

SEQ ID NO: 2838 - skipped

SEQ ID NO: 2839 - protein, 9 aa, Artificial Sequence
  source: /note="Description of Artificial Sequence: Synthetic peptide"
QQYGSSPRT

SEQ ID NO: 2840 - skipped

SEQ ID NO: 2841 - protein, 120 aa, Artificial Sequence
  source: /note="Description of Artificial Sequence: Synthetic polypeptide"
EVQLVESGGGLIKPGRSLRLSCTASGFTFGDYAMTWFRQAPGKGLEWVGFIRSKAYGGTTGYAASVRYRFTISRDDSSGIAYLQMDSLKTEDTAVYYCTRWDGWSQHDYWGQGTLVTVSS

SEQ ID NO: 2842 - skipped

SEQ ID NO: 2843 - protein, 9 aa, Artificial Sequence
  source: /note="Description of Artificial Sequence: Synthetic peptide"
LQDYNYPKT

SEQ ID NO: 2844 - skipped

SEQ ID NO: 2845 - protein, 118 aa, Artificial Sequence; identical to SEQ ID NO: 83
  source: /note="Description of Artificial Sequence: Synthetic polypeptide"

SEQ ID NO: 2846 - skipped

SEQ ID NO: 2847 - protein, 9 aa, Artificial Sequence
  source: /note="Description of Artificial Sequence: Synthetic peptide"
QLLNSYPYT

SEQ ID NO: 2848 - skipped

SEQ ID NO: 2849 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSLIYPGGSTYFADSVKGRFTISRDNSKNTLYLQMNSLRAEDTAVYYCAREGMGIAAAGTWGQGTLVTVSS

SEQ ID NO: 2850 - skipped

SEQ ID NO: 2851 - protein, 10 aa, Artificial Sequence
  source: /note="Description of Artificial Sequence: Synthetic peptide"
QQSYSTPPFT

SEQ ID NO: 2852 - skipped

SEQ ID NO: 2853 - protein, 117 aa, Artificial Sequence
  source: /note="Description of Artificial Sequence: Synthetic polypeptide"
EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDHWGQGTLVTVSS

SEQ ID NO: 2854 - skipped

SEQ ID NO: 2855 - protein, 10 aa, Artificial Sequence
  source: /note="Description of Artificial Sequence: Synthetic peptide"
QQRSNWPPLT

SEQ ID NO: 2856 - skipped

SEQ ID NO: 2857 - protein, 117 aa, Artificial Sequence
  source: /note="Description of Artificial Sequence: Synthetic polypeptide"
EVQLVESGGGLIQPGGSLKLSCVVSGFTVSKNYISWVRQAPGKGLEWVSVIFAGGSTFYADSVKGRFAISRDNSNNTLFLQMNSLRVEDTAIYYCARGDGELFFDQWGQGTLVTVSS

SEQ ID NO: 2858 - skipped

SEQ ID NO: 2859 - protein, 10 aa, Artificial Sequence
  source: /note="Description of Artificial Sequence: Synthetic peptide"
QQYNNWLSLT

SEQ ID NO: 2860 - skipped

SEQ ID NO: 2861 - protein, 120 aa, Artificial Sequence; identical to SEQ ID NO: 63
  source: /note="Description of Artificial Sequence: Synthetic polypeptide"

SEQ ID NO: 2862 - skipped

SEQ ID NO: 2863 - protein, 9 aa, Artificial Sequence
  source: /note="Description of Artificial Sequence: Synthetic peptide"
MQALQTPRT

SEQ ID NO: 2864 - skipped

SEQ ID NO: 2865 - protein, 120 aa, Artificial Sequence; identical to SEQ ID NO: 63
  source: /note="Description of Artificial Sequence: Synthetic polypeptide"

SEQ ID NO: 2866 - skipped

SEQ ID NO: 2867 - protein, 9 aa, Artificial Sequence
  source: /note="Description of Artificial Sequence: Synthetic peptide"
QQYDNLPYT

SEQ ID NO: 2868 - skipped

SEQ ID NO: 2869 - protein, 127 aa, Artificial Sequence
  source: /note="Description of Artificial Sequence: Synthetic polypeptide"
QVQLQESGPGLVKPSETLSLTCTVSGGSISNYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS

SEQ ID NO: 2870 - skipped

SEQ ID NO: 2871 - protein, 8 aa, Artificial Sequence
  source: /note="Description of Artificial Sequence: Synthetic peptide"
QQYDNVPL

SEQ ID NO: 2872 - skipped

SEQ ID NO: 2873 - protein, 127 aa, Artificial Sequence
  source: /note="Description of Artificial Sequence: Synthetic polypeptide"
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVEDWGYCSSTNCYSGAFDIWGQGTMVTVSS

SEQ ID NO: 2874 - skipped

SEQ ID NO: 2875 - protein, 9 aa, Artificial Sequence
  source: /note="Description of Artificial Sequence: Synthetic peptide"
MQGTHWLWT

SEQ ID NO: 2876 - protein, 119 aa, Artificial Sequence; identical to SEQ ID NO: 113
  source: /note="Description of Artificial Sequence: Synthetic polypeptide"

SEQ ID NO: 2877 - protein, 30 aa, Artificial Sequence
  source: /note="Description of Artificial Sequence: Synthetic polypeptide"
QVQLVESGGGVVQPGRSLRLSCAASGFTFS

SEQ ID NO: 2878 - protein, 5 aa, Artificial Sequence
  source: /note="Description of Artificial Sequence: Synthetic peptide"
SYAMH

SEQ ID NO: 2879 - protein, 14 aa, Artificial Sequence
  source: /note="Description of Artificial Sequence: Synthetic peptide"
WVRQAPGKGLEWVA

SEQ ID NO: 2880 - protein, 17 aa, Artificial Sequence
  source: /note="Description of Artificial Sequence: Synthetic peptide"
VIPFDGRNKYYADSVTG

SEQ ID NO: 2881 - protein, 32 aa, Artificial Sequence
  source: /note="Description of Artificial Sequence: Synthetic polypeptide"
RFTISRDNSKNTLYLQMNSLRAEDTAVYYCAS

SEQ ID NO: 2882 - protein, 10 aa, Artificial Sequence
  source: /note="Description of Artificial Sequence: Synthetic peptide"
SSGYLFHSDY

SEQ ID NO: 2883 - protein, 11 aa, Artificial Sequence
  source: /note="Description of Artificial Sequence: Synthetic peptide"
WGQGTLVTVSS

SEQ ID NO: 2884 - protein, 4 aa, Artificial Sequence
  source: /note="Description of Artificial Sequence: Synthetic peptide"
TVSS

SEQ ID NO: 2885 - protein, 329 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2886 - protein, 448 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2887 - protein, 465 aa, Artificial Sequence
  source: /note="Description of Artificial Sequence: Synthetic polypeptide"
MRAWIFFLLCLAGRALAQVQLVESGGGVVQPGRSLRLSCAASGFTFSSYAMHWVRQAPGKGLEWVAVIPFDGRNKYYADSVTGRFTISRDNSKNTLYLQMNSLRAEDTAVYYCASSSGYLFHSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2888 - protein, 107 aa, Artificial Sequence; identical to SEQ ID NO: 114
  source: /note="Description of Artificial Sequence: Synthetic polypeptide"

SEQ ID NO: 2889 - protein, 23 aa, Artificial Sequence
  source: /note="Description of Artificial Sequence: Synthetic peptide"
DIQMTQSPSTLSASVGDRVTITC

SEQ ID NO: 2890 - protein, 11 aa, Artificial Sequence
  source: /note="Description of Artificial Sequence: Synthetic peptide"
RASQSISNWLA

SEQ ID NO: 2891 - protein, 15 aa, Artificial Sequence
  source: /note="Description of Artificial Sequence: Synthetic peptide"
WFQQKPGKAPKLLIY

SEQ ID NO: 2892 - protein, 7 aa, Artificial Sequence
  source: /note="Description of Artificial Sequence: Synthetic peptide"
EASSLES

SEQ ID NO: 2893 - protein, 32 aa, Artificial Sequence
  source: /note="Description of Artificial Sequence: Synthetic polypeptide"
GVPSRFSGSGSGTEFTLTISSLQPDDFATYYC

SEQ ID NO: 2894 - protein, 9 aa, Artificial Sequence
  source: /note="Description of Artificial Sequence: Synthetic peptide"
QQYNSYPWT

SEQ ID NO: 2895 - protein, 10 aa, Artificial Sequence
  source: /note="Description of Artificial Sequence: Synthetic peptide"
FGQGTKVEIK

SEQ ID NO: 2896 - protein, 5 aa, Artificial Sequence
  source: /note="Description of Artificial Sequence: Synthetic peptide"
KVEIK

SEQ ID NO: 2897 - protein, 107 aa, Artificial Sequence [sequence omitted]

SEQ ID NO: 2898 - protein, 214 aa, Artificial Sequence
  source: /note="Description of Artificial Sequence: Synthetic polypeptide"
DIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2899 - protein, 231 aa, Artificial Sequence
  source: /note="Description of Artificial Sequence: Synthetic polypeptide"
MRAWIFFLLCLAGRALADIQMTQSPSTLSASVGDRVTITCRASQSISNWLAWFQQKPGKAPKLLIYEASSLESGVPSRFSGSGSGTEFTLTISSLQPDDFATYYCQQYNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2900 - protein, 131 aa, Artificial Sequence
  source: /note="Description of Artificial Sequence: Synthetic polypeptide"
EVQLVESGGGLIQPGGSLRLSCAASGFTVSNNYMSWVRQAPGKGLEWVSVIYSGGSTYYADSVKGRFTISRDKSKNTLYLQMNSLRAEDTAVYYCAREGEVEGYNDFWSGYSRDRYYFDYWGQGTLVTVSS

SEQ ID NO: 2901 - protein, 30 aa, Artificial Sequence
  source: /note="Description of Artificial Sequence: Synthetic polypeptide"
EVQLVESGGGLIQPGGSLRLSCAASGFTVS

SEQ ID NO: 2902 - protein, 5 aa, Artificial Sequence
  source: /note="Description of Artificial Sequence: Synthetic peptide"
NNYMS

SEQ ID NO: 2903 - protein, 14 aa, Artificial Sequence
  source: /note="Description of Artificial Sequence: Synthetic peptide"
WVRQAPGKGLEWVS

SEQ ID NO: 2904 - protein, 16 aa, Artificial Sequence
  source: /note="Description of Artificial Sequence: Synthetic peptide"
VIYSGGSTYYADSVKG

SEQ ID NO: 2905 - protein, 32 aa, Artificial Sequence
  source: /note="Description of Artificial Sequence: Synthetic polypeptide"
RFTISRDKSKNTLYLQMNSLRAEDTAVYYCAR

SEQ ID NO: 2906 - protein, 23 aa, Artificial Sequence
  source: /note="Description of Artificial Sequence: Synthetic peptide"
EGEVEGYNDFWSGYSRDRYYFDY

SEQ ID NO: 2907 - protein, 11 aa, Artificial Sequence
  source: /note="Description of Artificial Sequence: Synthetic peptide"
WGQGTLVTVSS

SEQ ID NO: 2908 - protein, 4 aa, Artificial Sequence
  source: /note="Description of Artificial Sequence: Synthetic peptide"
TVSS

SEQ ID NO: 2909 - protein, 329 aa, Artificial Sequence; identical to SEQ ID NO: 2885
  source: /note="Description of Artificial Sequence: Synthetic polypeptide"

SEQ ID NO: 2910 - protein, 460 aa, Artificial Sequence
  source: /note="Description of Artificial Sequence: Synthetic polypeptide"
EVQLVESGGGLIQPGGSLRLSCAASGFTVSNNYMSWVRQAPGKGLEWVSVIYSGGSTYYADSVKGRFTISRDKSKNTLYLQMNSLRAEDTAVYYCAREGEVEGYNDFWSGYSRDRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2911 - protein, 477 aa, Artificial Sequence
  source: /note="Description of Artificial Sequence: Synthetic polypeptide"
MRAWIFFLLCLAGRALAEVQLVESGGGLIQPGGSLRLSCAASGFTVSNNYMSWVRQAPGKGLEWVSVIYSGGSTYYADSVKGRFTISRDKSKNTLYLQMNSLRAEDTAVYYCAREGEVEGYNDFWSGYSRDRYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2912 - protein, 110 aa, Artificial Sequence; identical to SEQ ID NO: 126
  source: /note="Description of Artificial Sequence: Synthetic polypeptide"

SEQ ID NO: 2913 - protein, 22 aa, Artificial Sequence
  source: /note="Description of Artificial Sequence: Synthetic peptide"
QSALTQPASVSGSPGQSITISC

SEQ ID NO: 2914 - protein, 14 aa, Artificial Sequence
  source: /note="Description of Artificial Sequence: Synthetic peptide"
TGTSSDVGGYNYVS

SEQ ID NO: 2915 - protein, 15 aa, Artificial Sequence
  source: /note="Description of Artificial Sequence: Synthetic peptide"
WYQQHPGKAPKLMIY

SEQ ID NO: 2916 - protein, 7 aa, Artificial Sequence
  source: /note="Description of Artificial Sequence: Synthetic peptide"
DVSNRPS

SEQ ID NO: 2917 - protein, 32 aa, Artificial Sequence
  source: /note="Description of Artificial Sequence: Synthetic polypeptide"
GVSNRFSGSKSGNTASLTISGLQAEDEADYYC

SEQ ID NO: 2918 - protein, 10 aa, Artificial Sequence
  source: /note="Description of Artificial Sequence: Synthetic peptide"
SSYTSSSTRV

SEQ ID NO: 2919 - protein, 10 aa, Artificial Sequence
  source: /note="Description of Artificial Sequence: Synthetic peptide"
FGTGTKVTVL

SEQ ID NO: 2920 - protein, 106 aa, Artificial Sequence
  source: /note="Description of Artificial Sequence: Synthetic polypeptide"
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2921 - protein, 216 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2922 - protein, 233 aa, Artificial Sequence
  source: /note="Description of Artificial Sequence: Synthetic polypeptide"
MRAWIFFLLCLAGRALAQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2923 - DNA, 1398 bp, Artificial Sequence
  source: /note="Description of Artificial Sequence: Synthetic polynucleotide"
atgagggcttggatcttctttctgctctgcctggccgggagagcgctcgcacaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttataccatttgatggaagaaataagtactacgcagactccgtgacgggccgattcaccatctccagagacaattccaagaacacactgtatctgcaaatgaacagcctgagagctgaggacacggctgtgtattactgtgcgagtagtagtggttatcttttccactctgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgctgcatgaggctctgcacagccactacacgcagaagagcctctccctgtccccgggttga

SEQ ID NO: 2924 - DNA, 696 bp, Artificial Sequence
  source: /note="Description of Artificial Sequence: Synthetic polynucleotide"
atgagggcttggatcttctttctgctctgcctggccgggcgcgccttggccgacatccagatgacccagtctccttccaccctgtctgcatctgtaggagacagagtcaccatcacttgccgggccagtcagagtattagtaactggttggcctggtttcagcagaaaccagggaaagcccctaagctcctgatctatgaggcgtctagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2925 - DNA, 1434 bp, Artificial Sequence
  source: /note="Description of Artificial Sequence: Synthetic polynucleotide"
atgagggcttggatcttctttctgctctgcctggccgggagagcgctcgcagaggtgcagctggtggagtctggaggaggcttgatccagcctggggggtccctgagactctcctgtgcagcctctgggttcaccgtcagtaacaactacatgagctgggtccgccaggctccagggaaggggctggagtgggtctcagttatttatagcggtggtagcacatactacgcagactccgtgaagggccgattcaccatctccagagacaaatccaagaacacgctgtatcttcaaatgaacagcctgagagccgaggacacggccgtgtattattgtgcgagagaaggggaggtagaagggtataacgatttttggagtggttattctagagaccgttactactttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgctgcatgaggctctgcacagccactacacgcagaagagcctctccctgtccccgggttga

SEQ ID NO: 2926 - DNA, 702 bp, Artificial Sequence
  source: /note="Description of Artificial Sequence: Synthetic polynucleotide"
atgagggcttggatcttctttctgctctgcctggccgggcgcgccttggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacccgagtcttcggaactgggaccaaggtcaccgtcctaggtcagcccaaggctgccccctcggttaccctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2927 - protein, 1273 aa, Severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2928 - skipped

SEQ ID NO: 2929 - protein, 121 aa, Artificial Sequence
  source: /note="Description of Artificial Sequence: Synthetic polypeptide"
QVQLLESGGGLVKPGGSLRLSCAASGFTFSDYYMSWIRQAPGKGLEWVSYISSRSSYTNYADSVKGRFTISRDNAKNSLYLQMNSLRAEDTAVYYCATYRSYLPLVQVDYWGQGTLVTVSS

SEQ ID NO: 2930-2932 - skipped (3 entries)

SEQ ID NO: 2933 - protein, 118 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGQLLPFADYWGQGTLVTVSS

SEQ ID NO: 2934-2936 - skipped (3 entries)

SEQ ID NO: 2937 - protein, 132 aa, Artificial Sequence
  source: /note="Description of Artificial Sequence: Synthetic polypeptide"
EVQLVESGGGLVKPGGSLRVSCAASGFTFSSYSMNWVRQAPGKGLEWVSSISSSKNYIYYADSVKGRFTISRDNAKNSLYLQMNSLRAEDTAVYYCTRGSRGYYDRSGYYTPLDPYYGMDVWGQGTTVTVSS

SEQ ID NO: 2938-2940 - skipped (3 entries)

SEQ ID NO: 2941 - protein, 121 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSGISDSGGSTYYADSVKGRFTISRDNSKNTLYLQMNSLRAEDTAVYYCAKEEVLPAVEYFQHWGQGTLVTVSS

SEQ ID NO: 2942-2944 - skipped (3 entries)

SEQ ID NO: 2945 - protein, 126 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLDLQMNSLRAEDTAVYYCAKGGYYYYNSDSYQAEIDYWGQGTLVTVSS

SEQ ID NO: 2946-2948 - skipped (3 entries)

SEQ ID NO: 2949 - protein, 124 aa, Artificial Sequence
  source: /note="Description of Artificial Sequence: Synthetic polypeptide"
QVQLVESGGGVVQPGRSLRLSCAASGFTFSSSGMHWVRQAPGKGLEWVAIISYDGSNKYYADSVKGRFTISRDNSKNTLSLQMNSLRAEDTAVYYCAKDPLPFRDFFYYYMDVWGKGTTVTVSS

SEQ ID NO: 2950-2952 - skipped (3 entries)

SEQ ID NO: 2953 - protein, 128 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARETQGGYYGSGSYYASPFDPWGQGTLVTVSS

SEQ ID NO: 2954-2956 - skipped (3 entries)

SEQ ID NO: 2957 - protein, 118 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDFYHNWFDPWGQGTLVTVSS

SEQ ID NO: 2958-2960 - skipped (3 entries)

SEQ ID NO: 2961 - protein, 124 aa, Artificial Sequence
  source: /note="Description of Artificial Sequence: Synthetic polypeptide"
QVQLVESGGGVVQPGRSLRLSCAASGLTFSSYGMHWVRQAPGKGLEWVAVIWYDGINKYYADSVKGRFTISRDNSKNTLYLQMNSLRAEDTAVYYCARDRGLRLGGPKYYFDYWGQGTLVTVSS

SEQ ID NO: 2962-2964 - skipped (3 entries)

SEQ ID NO: 2965 - protein, 121 aa, Artificial Sequence
  source: /note="Description of Artificial Sequence: Synthetic polypeptide"
EVQLVESGGGLVQPGGSLRLSCAASGFTFSSYYMNWVRQAPGKGLEWVSYISSSSSTIYYADSVKGRFTISRDNAKNSLYLQMNSLRDEDTAVYYCARDPQRDPADYFDYWGQGTLVTVSS

SEQ ID NO: 2966-2968 - skipped (3 entries)

SEQ ID NO: 2969 - protein, 119 aa, Artificial Sequence
  source: /note="Description of Artificial Sequence: Synthetic polypeptide"
EVQLVESGGGLVQPGGSLRLSCAASGFTFSSYWMSWVRQAPGKGLEWVANIKQDGSEKYYVDSVKGRFTISGDNAKNSLYLHMNSLRAEDTAVYYCAIQLWLRGGYDYWGQGTLVTVSS

SEQ ID NO: 2970-2972 - skipped (3 entries)

SEQ ID NO: 2973 - protein, 119 aa, Artificial Sequence
  source: /note="Description of Artificial Sequence: Synthetic polypeptide"
EVQLVESGGGLVQPGGSLRLSCADSGFTFSSYWMSWVRQAPGKGLEWVANIKQDGSEKYYVDSVKGRFTISRDNAKNSLYLQMNSLRAEDTAVYYCAVQLWLRGNFDYWGQGTLVTVSS

SEQ ID NO: 2974-2976 - skipped (3 entries)

SEQ ID NO: 2977 - protein, 121 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSRGYADSVKGRFTISRDNAKNSLYLLMNSLRAEDTAFYYCAKDDREGFGDYFDYWGQGTLVTVSS

SEQ ID NO: 2978-2980 - skipped (3 entries)

SEQ ID NO: 2981 - protein, 124 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYADSVKGRFTISRDNAKSSLYLQMKSLRVEDTALYYCAKDSLVRRNFYYYYMDVWGKGTTVTVSS

SEQ ID NO: 2982-2984 - skipped (3 entries)

SEQ ID NO: 2985 - protein, 126 aa, Artificial Sequence
  source: /note="Description of Artificial Sequence: Synthetic polypeptide"
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGMYYDILTGYSEGAFDIWGQGTMVTVSS

SEQ ID NO: 2986-2988 - skipped (3 entries)

SEQ ID NO: 2989 - protein, 123 aa, Artificial Sequence
  source: /note="Description of Artificial Sequence: Synthetic polypeptide"
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGGTNPQWLDSTFDYWGQGTLVTVSS

SEQ ID NO: 2990-2992 - skipped (3 entries)

SEQ ID NO: 2993 - protein, 123 aa, Artificial Sequence
  source: /note="Description of Artificial Sequence: Synthetic polypeptide"
QLQLQESGPGLVKPSETLSLTCTVSGGSISSSSHYWGWIRQPPGKGLEWIGTIYYSGSTYYNPSLKSRVTISVDTSKNQFSLRLSSVTAADTAVYYCASAPYLNWNDWIFDYWGQGTLVTVSS

SEQ ID NO: 2994-2996 - skipped (3 entries)

SEQ ID NO: 2997 - protein, 118 aa, Artificial Sequence; identical to SEQ ID NO: 95
  source: /note="Description of Artificial Sequence: Synthetic polypeptide"

SEQ ID NO: 2998-3000 - skipped (3 entries)

SEQ ID NO: 3001 - protein, 122 aa, Artificial Sequence
  source: /note="Description of Artificial Sequence: Synthetic polypeptide"
QVQLQESGPGLVKPSETLSLTCTVSGGSISGYYWSWIRQPPGKGLEWIGYIYYSGSTNYNPSLKSRVTISVDTSKNQFSLKLSSVTAADTAVYYCARYGWGYDSSGYYFDYWGQGTLVTVSS

SEQ ID NO: 3002-3004 - skipped (3 entries)

SEQ ID NO: 3005 - protein, 118 aa, Artificial Sequence
  source: /note="Description of Artificial Sequence: Synthetic polypeptide"
QVQLQESGPRLVKPSENLSLTCTVSGGSISSYYWSWIRQPPGKGLEWIGYIYYTGSTKYNPSLKSRVTISVDTSKNQFSLKLSSVTAADTAVFYCARATTPFSGVDYWGQGTLVTVSS

SEQ ID NO: 3006-3008 - skipped (3 entries)

SEQ ID NO: 3009 - protein, 120 aa, Artificial Sequence
  source: /note="Description of Artificial Sequence: Synthetic polypeptide"
QVQLQESGPGLVKPSETLSLTCTVSGGSISNYYWSWIRQPPGKGLEWIGYIYYSGSTNYNPSLKSRVTISVDTSKNQFSLKLTSVTAADTAVYYCARILRGVAENWFDPWGQGTLVTVSS

SEQ ID NO: 3010-3012 - skipped (3 entries)

SEQ ID NO: 3013 - protein, 127 aa, Artificial Sequence
  source: /note="Description of Artificial Sequence: Synthetic polypeptide"
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCATRGGYYDSSGYYALAFDIWGQGTMVTVSS

SEQ ID NO: 3014-3016 - skipped (3 entries)

SEQ ID NO: 3017 - protein, 126 aa, Artificial Sequence
  source: /note="Description of Artificial Sequence: Synthetic polypeptide"
EVQLVQSGAEVKQPGESLKISCKALGYTFTTSWISWVRQMPGKGLEWMGRIDPSDSYTKYSPSFQGHVTISVDKSITTAYLQWSSLKASDSAVYYCATETNSETTDMFTGYSFDPWGQGTLVTVSS

SEQ ID NO: 3018-3020 - skipped (3 entries)

SEQ ID NO: 3021 - protein, 123 aa, Artificial Sequence
  source: /note="Description of Artificial Sequence: Synthetic polypeptide"
EVQLVQSGAEVKKPGESLKISCKGSGYRFTSYWIAWVRQMPGKGLEWMGIIYPGDSDTRYSPSFQGQVTISADQSISTAYLQWSSLKASDTAMYYCARGGPPGGVKLELTDYWGQGALVTVSS

SEQ ID NO: 3022-3024 - skipped (3 entries)

SEQ ID NO: 3025 - protein, 125 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGILYPGDSDTTYSPSFQGQVTISADKSISTAYLQWSSLKASDTAMYYCARLHPTYYDILTGYYIDYWGQGTLVTVSS

SEQ ID NO: 3026-3028 - skipped (3 entries)

SEQ ID NO: 3029 - protein, 120 aa, Artificial Sequence
  source: /note="Description of Artificial Sequence: Synthetic polypeptide"
EVQLVQSGAEVKKPGESLKISCKGSGYSFISYWIGWVRQMPGKGLEWMGIIYPGDSDTRYSPSFQGQVTISADKSISTAYLQWSSLKASDTAMYYCARRPSSYSGWFDPWGQGTLVTVSS

SEQ ID NO: 3030-3032 - skipped (3 entries)

SEQ ID NO: 3033 - protein, 128 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREPQINPYYDILTGYRAFDYWGQGTLVTVSS

SEQ ID NO: 3034-3036 - skipped (3 entries)

SEQ ID NO: 3037 - protein, 132 aa, Artificial Sequence
  source: /note="Description of Artificial Sequence: Synthetic polypeptide"
QVQLVQSGAEVVRPGASVKVSCKASGYTFTTHYMHWVRQAPGQGLEWMGIINPSVGSTSYAQKFQGRVTMTRDTSTSTVYMELSSLISEDTAMYYCARGPRSPSDWCSGGSCYDDQNWFDPWGQGTLVTVSS

SEQ ID NO: 3038-3040 - skipped (3 entries)

SEQ ID NO: 3041 - protein, 124 aa, Artificial Sequence
  source: /note="Description of Artificial Sequence: Synthetic polypeptide"
QVQLVQSGAEVMKPGASVKVSCKASGYTFTSYYMHWVRQAPGQGLEWMGIINPTAGSTSYAQKFQGRVTMTRDTSTSTVYMELSSLRSEDTAVYYCARDFELWFGELRGWFDPWGQGTLVTVSS

SEQ ID NO: 3042-3044 - skipped (3 entries)

SEQ ID NO: 3045 - protein, 122 aa, Artificial Sequence
  source: /note="Description of Artificial Sequence: Synthetic polypeptide"
QVQLVQSGAEVKKPGSSVKVSCKASGGTFSIYAISWVRQAPGQGLEWMGGIIPILGTANYAQKFQGRVTITADESTSTAYMELSSLRSEDTAVYYCASFHVAYGDYIPFDYWGQGTLVTVSS

SEQ ID NO: 3046-3048 - skipped (3 entries)

SEQ ID NO: 3049 - protein, 126 aa, Artificial Sequence
  source: /note="Description of Artificial Sequence: Synthetic polypeptide"
QVQLVQSGAEVKKSGSSVKVSCKASGGTFSSYGISWVRQAPGQGLEWMGGIIPIIGTANYAQKFQGRVTITADESMSTAYMELSSLRSEDTAVYYCARAGLLTKNIVATIGCFDPWGQGTLVTVSS

SEQ ID NO: 3050-3052 - skipped (3 entries)

SEQ ID NO: 3053 - protein, 127 aa, Artificial Sequence
  source: /note="Description of Artificial Sequence: Synthetic polypeptide"
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGRYCSSTSCYSHVGFDPWGQGTLVTVSS

SEQ ID NO: 3054-3056 - skipped (3 entries)

SEQ ID NO: 3057 - protein, 122 aa, Artificial Sequence
  source: /note="Description of Artificial Sequence: Synthetic polypeptide"
EVQLVESGGGLVQPGGSLRLSCAASGFTFSNYDMHWVRQATGRGLEWVSTIGTAGDTYYPGSVKGRFTISRENAKNSLYLQMNSLRAGDTALYYCARVRYDSSGYFWSLDYWGQGTLVTVSS

SEQ ID NO: 3058-3060 - skipped (3 entries)

SEQ ID NO: 3061 - protein, 128 aa, Artificial Sequence
  source: /note="Description of Artificial Sequence: Synthetic polypeptide"
EVQLVESGGGLVQPGGSLRLSCAASGFTFSSYDMHWVRQATGKGLEWVSTIGTAGDTYYPGSVKGRFTISRENAKNSLYLQMNSLRAGDTAVYFCARGVSGVVRGVIRSFYYYGLDVWGQGTTVTVSS

SEQ ID NO: 3062-3064 - skipped (3 entries)

SEQ ID NO: 3065 - protein, 127 aa, Artificial Sequence
  source: /note="Description of Artificial Sequence: Synthetic polypeptide"
EVQLLESGGGLVQPGGSLRLSCAASGITFSSYAMTWVRQAPGKGLEWVSTISGSGGGTYYADSVKGRFTISRDNSKNTLYLQMNSLRAEDTAVYYCVETNLWFGEDNYYYYYGMDVWGQGTTVTVSS

SEQ ID NO: 3066-3068 - skipped (3 entries)

SEQ ID NO: 3069 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCATGGGSYFSPRIYFDYWGQGTLVTVSS

SEQ ID NO: 3070-3072 - skipped (3 entries)

SEQ ID NO: 3073 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKQAGPYCSGGTCYPGTLDYWGQGTLVTVSS

SEQ ID NO: 3074-3076 - skipped (3 entries)

SEQ ID NO: 3077 - protein, 123 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAGYSYGYPQQYFDYWGQGTLVTVSS

SEQ ID NO: 3078-3080 - skipped (3 entries)

SEQ ID NO: 3081 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVILYDGSNKYYADSVKGRFTISRDNSKNTLYLQMNSLRAEDTAVYYCAKSLGPYCSGGNCYSSYFDYWGQGTLVTVSS

SEQ ID NO: 3082-3084 - skipped (3 entries)

SEQ ID NO: 3085 - protein, 127 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYGDSVKGRFTISRDNSKNTLYLQMNSLRAEDTAVYYCAKKGGGAYCGGDCYLGEFDYWGQGTLVTVSS

SEQ ID NO: 3086-3088 - skipped (3 entries)

SEQ ID NO: 3089 - protein, 120 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISDDGSNKYYADSVKGRFTISRDNSKNTLYLQMNSLRAEDTAVYYCAKSWWLSENWFDPWGQGTLVTVSS

SEQ ID NO: 3090-3092 - skipped (3 entries)

SEQ ID NO: 3093 - protein, 126 aa, Artificial Sequence
  source: /note="Description of Artificial Sequence: Synthetic polypeptide"
QVQLVESGGGVVQPGRSLRLSCAASGFTFSTYGMHWVRQAPGKGLEWVAVISYDGSNKYYADSVKGRFTISRDNSKNTLYLQMNSLRAEDTAVYYCAKGGLYDSSGYYPHYGMDVWGQGTTVTVSS

SEQ ID NO: 3094-3096 - skipped (3 entries)

SEQ ID NO: 3097 - protein, 123 aa, Artificial Sequence
  source: /note="Description of Artificial Sequence: Synthetic polypeptide"
QVQLVESGGGVVQPGRSLRLSCAASGFTFSSYAMHWVRQAPGKGLEWVAVILYDGSNKYYADSVKGRFTISRDNSKNTLYLQMNSLRAEDTAVYYCARDQDLDTAMVTLFDYWGQGTLVTVSS

SEQ ID NO: 3098-3100 - skipped (3 entries)

SEQ ID NO: 3101 - protein, 123 aa, Artificial Sequence
  source: /note="Description of Artificial Sequence: Synthetic polypeptide"
QVQLVESGGGVVQPGRSLRLSCAASGFTFSSYAIHWVRQAPGKGLEWVAVISYDGSNKYYADSVKGRFTISRDNSKNTLYLQMNSLRADDTAVYYCARDSPSQIVVVPVFDYWGQGTLVTVSS

SEQ ID NO: 3102-3104 - skipped (3 entries)

SEQ ID NO: 3105 - protein, 125 aa, Artificial Sequence; identical to SEQ ID NO: 91
  source: /note="Description of Artificial Sequence: Synthetic polypeptide"

SEQ ID NO: 3106-3108 - skipped (3 entries)

SEQ ID NO: 3109 - protein, 125 aa, Artificial Sequence
  source: /note="Description of Artificial Sequence: Synthetic polypeptide"
EVQLVESGGDLVQPGGSLRLSCAASGFTFSSYSMNWVRQAPGKGLEWVSYISISSSTIYYADSVKGRFTISRDNAKNSLYLQMNSLRDEDTAVYYCARVAIRVVVPSATYYFDYWGQGTLVTVSS

SEQ ID NO: 3110-3112 - skipped (3 entries)

SEQ ID NO: 3113 - protein, 129 aa, Artificial Sequence
  source: /note="Description of Artificial Sequence: Synthetic polypeptide"
EVQLVESGGGLVQPGGSLRLSCAASGFTFSSYSMNWVRQAPGKGLEWVSYISTSSSTIYYADSVQGRFTISRDNAKNSLYLQMNSLRDEDTAVYYCARDQGYCSSTSCYDGYYYYMDVWGKGTTVTVSS

SEQ ID NO: 3114-3116 - skipped (3 entries)

SEQ ID NO: 3117 - protein, 118 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTISSDNSKNTLYLQMNSLRAEDTAVYYCARDLRGPGTFDIWGQGTMVTVSS

SEQ ID NO: 3118-3120 - skipped (3 entries)

SEQ ID NO: 3121 - protein, 115 aa, Artificial Sequence
  source: /note="Description of Artificial Sequence: Synthetic polypeptide"
EVQLVESGGGLIQPGGSLRLSCAASGLTVSSNYMSWVRQAPGKGLEWVSVIYSGGSTFYADSVKGRFTISRDNSKNTLYLQMNSLRAEDTAVYYCAREVAAFDIWGQGTMVTVSS

SEQ ID NO: 3122-3124 - skipped (3 entries)

SEQ ID NO: 3125 - protein, 116 aa, Artificial Sequence; identical to SEQ ID NO: 89
  source: /note="Description of Artificial Sequence: Synthetic polypeptide"

SEQ ID NO: 3126-3128 - skipped (3 entries)

SEQ ID NO: 3129 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSIIYSGGSTFYADSVKGRFTISRDNSKNTLYLQMNSLRAEDTAVYYCARTMDGDYFDYWGQGTLVTVSS

SEQ ID NO: 3130-3132 - skipped (3 entries)

SEQ ID NO: 3133 - protein, 124 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSLIYSGGSTYYADSVKGRFTISRDNSKNTLYLQMNSLRAEDTAVYYCARTDIVVVPAARGFYFDYWGQGTLVTVSS

SEQ ID NO: 3134-3136 - skipped (3 entries)

SEQ ID NO: 3137 - protein, 119 aa, Artificial Sequence; identical to SEQ ID NO: 87
  source: /note="Description of Artificial Sequence: Synthetic polypeptide"

SEQ ID NO: 3138-3140 - skipped (3 entries)

SEQ ID NO: 3141 - protein, 117 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCARDLGTGLFDYWGQGTLVTVSS

SEQ ID NO: 3142-3144 - skipped (3 entries)

SEQ ID NO: 3145 - protein, 117 aa, Artificial Sequence
  source: /note="Description of Artificial Sequence: Synthetic polypeptide"
EVQLVESGGGLIQPGGSLRLSCAASGFIVSSNYMSWVRQAPGKGLEWVSVIYSGGSTYYADSVKGRFTISRDNSKNTLYLQMNSLRAEDTAVYYCARDYGDFYFDYWGQGTLVTVSS

SEQ ID NO: 3146-3148 - skipped (3 entries)

SEQ ID NO: 3149 - protein, 117 aa, Artificial Sequence
  source: /note="Description of Artificial Sequence: Synthetic polypeptide"
EVQLVESGGGLIQPGGSLRLSCAASGFTVSYNYMSWVRQAPGKGLEWVSIIYSGGSTYYADSVKGRFTISRDNSKNTLYLQMNSLRAEDTAIYYCARDYGDLYFDYWGQGTLVTVSS

SEQ ID NO: 3150-3152 - skipped (3 entries)

SEQ ID NO: 3153 - protein, 116 aa, Artificial Sequence
  source: /note="Description of Artificial Sequence: Synthetic polypeptide"
EVQLVESGGGLIQPGGSLRLSCAASGFTVSSNYMSWVRQAPGKGLEWVSVIYSGGSTYYADSVKGRFTISRDNSKNTLYLQMNSLRADDTAVYYCATDLTSGRGPWGQGTLVTVSS

SEQ ID NO: 3154-3156 - skipped (3 entries)

SEQ ID NO: 3157 - protein, 117 aa, Artificial Sequence
  source: /note="Description of Artificial Sequence: Synthetic polypeptide"
EVQLVESGGGLIQPGGSLRLSCAASGFTVSSNYMTWVRQAPGKGLEWVSVIYSGGTTYYADSVKGRFTISRDNSKNTLYLQMNSLRAEDTAVYYCARDLVVWGMDVWGQGTTVTVSS

SEQ ID NO: 3158-3160 - skipped (3 entries)

SEQ ID NO: 3161 - protein, 128 aa, Artificial Sequence
  source: /note="Description of Artificial Sequence: Synthetic polypeptide"
EVQLVESGGGLVQPGGSLKLSCAASGFTFSGSAMHWVRQASGKGLEWVGRIRSKANSYATTYAASVKGRFTISRDDSKNTAYLQMNSLKTEDTAVYYCTKPHAHCGGDCYSRDWFDPWGQGTLVTVSS

SEQ ID NO: 3162-3164 - skipped (3 entries)

SEQ ID NO: 3165 - protein, 124 aa, Artificial Sequence
  source: /note="Description of Artificial Sequence: Synthetic polypeptide"
EVQLVESGGGLVQPGRSLRLSCAASGFTFDDYAIHWVRQAPEKGLEWVSGINWSSGSIVYADSVKGRFTISRDNAKNSLYLQMNSLRAEDTALYYCAKGLIAELVGGGWYFDYWGQGTLVTVSS

SEQ ID NO: 3166-3168 - skipped (3 entries)

SEQ ID NO: 3169 - protein, 123 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGVSWNSGSIGYADSVRGRFTISRDNAKNSLYLQMNSLRAEDTALYYCAKALSSTGFLVVYFDYWGRGTLVTVSS

SEQ ID NO: 3170-3172 - skipped (3 entries)

SEQ ID NO: 3173 - protein, 130 aa, Artificial Sequence
  source: /note="Description of Artificial Sequence: Synthetic polypeptide"
  MOD_RES (76)..(76): Any amino acid
QVQLQESGPGLVKPSQTLSLTCTVSGGSISSGGYYWSWIRQHPGKGLEWIGYIYYSGSTYYNPSLKSRVTISVDTXKNQFSLKLSSVTAADTAVYYCAWRYSSSWYTVDNKKGDYYFDYWGQGTLVTVSS

SEQ ID NO: 3174-3176 - skipped (3 entries)

SEQ ID NO: 3177 - protein, 118 aa, Artificial Sequence
  source: /note="Description of Artificial Sequence: Synthetic polypeptide"
EVQLVQSGAEVKKPGESLRISCKGSAYIFTTYWISWVRQMPGKGLEWMGRIDPSDSYTNYSPSFQGHVTISADKSISTAYLQWSSLKASDTAMYYCARHISSGWYDYWGQGTLVTVSS

SEQ ID NO: 3178-3180 - skipped (3 entries)

SEQ ID NO: 3181 - protein, 123 aa, Artificial Sequence
  source: /note="Description of Artificial Sequence: Synthetic polypeptide"
EVQLVQSGAEVKKPGESLRISCKGSGYSFTSYYISWVRQMPGKGLEWMGRIDPSDSYTNYSPSFQGHVTISADKSISAAYLQWSSLKASDTAMYYCARHRHPGITMIVALDYWGQGTLVTVSS

SEQ ID NO: 3182-3184 - skipped (3 entries)

SEQ ID NO: 3185 - protein, 120 aa, Artificial Sequence
  source: /note="Description of Artificial Sequence: Synthetic polypeptide"
EVQLVQSGAEVKKPGESLKISCKGSGYSFTSYWIGWVRQMPGKDLEWMGIIYPGDSDTRYSPSFQGQVTISADKSISTAYLQWSSLKASDTAMYYCALTTVTTGRWFDPWGQGTLVTVSS

SEQ ID NO: 3186 - protein, 124 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSSPYTNYADSVKGRFTISRDNAKNSLYLQMNSLRAEDTAVYYCARGPSSTHESRPRPFDYWGQGTLVTVSS

SEQ ID NO: 3187 - protein, 122 aa, Artificial Sequence
  source: /note="Description of Artificial Sequence: Synthetic polypeptide"
EVQLVESGGGLVKPGGSLRVSCAASGFTFTNAWMSWVRQAPGKGLEWVGRIKSKTDGGTTDYAAPVKGRFTISRDDSKNTLYLQMNSLKTEDTAVYYCTTSRGGDWPVTDYWGQGTLVTVSS

SEQ ID NO: 3188 - protein, 130 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKGGPDYYDSSGYIRSKPEYFQHWGQGTLVTVSS

SEQ ID NO: 3189 - protein, 23 aa, Artificial Sequence
  source: /note="Description of Artificial Sequence: Synthetic peptide"
ARGPPIEGWLRLGLGGGDWYFDL

SEQ ID NO: 3190 - protein, 13 aa, Artificial Sequence
  source: /note="Description of Artificial Sequence: Synthetic peptide"
ARHDEVDTAAGGY

SEQ ID NO: 3191 - protein, 20 aa, Artificial Sequence
  source: /note="Description of Artificial Sequence: Synthetic peptide"
AKQAGPYCSGGTCYPGTLDY

SEQ ID NO: 3192 - protein, 16 aa, Artificial Sequence
  source: /note="Description of Artificial Sequence: Synthetic peptide"
AKAGYSYGYPQQYFDY

SEQ ID NO: 3193 - protein, 20 aa, Artificial Sequence
  source: /note="Description of Artificial Sequence: Synthetic peptide"
AKSLGPYCSGGNCYSSYFDY

SEQ ID NO: 3194 - protein, 20 aa, Artificial Sequence
  source: /note="Description of Artificial Sequence: Synthetic peptide"
AKKGGGAYCGGDCYLGEFDY

SEQ ID NO: 3195 - protein, 13 aa, Artificial Sequence
  source: /note="Description of Artificial Sequence: Synthetic peptide"
AKSWWLSENWFDP

SEQ ID NO: 3196 - protein, 19 aa, Artificial Sequence
  source: /note="Description of Artificial Sequence: Synthetic peptide"
AKGGLYDSSGYYPHYGMDV

SEQ ID NO: 3197 - protein, 16 aa, Artificial Sequence
  source: /note="Description of Artificial Sequence: Synthetic peptide"
ARDQDLDTAMVTLFDY

SEQ ID NO: 3198 - protein, 16 aa, Artificial Sequence
  source: /note="Description of Artificial Sequence: Synthetic peptide"
ARDSPSQIVVVPVFDY

SEQ ID NO: 3199 - protein, 18 aa, Artificial Sequence
  source: /note="Description of Artificial Sequence: Synthetic peptide"
AREGARVGATYDTYYFDY

SEQ ID NO: 3200 - protein, 18 aa, Artificial Sequence
  source: /note="Description of Artificial Sequence: Synthetic peptide"
ARVAIRVVVPSATYYFDY

SEQ ID NO: 3201 - protein, 22 aa, Artificial Sequence
  source: /note="Description of Artificial Sequence: Synthetic peptide"
ARDQGYCSSTSCYDGYYYYMDV

SEQ ID NO: 3202 - protein, 12 aa, Artificial Sequence
  source: /note="Description of Artificial Sequence: Synthetic peptide"
ARDLRGPGTFDI

SEQ ID NO: 3203 - protein, 9 aa, Artificial Sequence
  source: /note="Description of Artificial Sequence: Synthetic peptide"
AREVAAFDI

SEQ ID NO: 3204 - protein, 10 aa, Artificial Sequence
  source: /note="Description of Artificial Sequence: Synthetic peptide"
ARDLSAAFDI

SEQ ID NO: 3205 - protein, 11 aa, Artificial Sequence
  source: /note="Description of Artificial Sequence: Synthetic peptide"
ARTMDGDYFDY

SEQ ID NO: 3206 - protein, 18 aa, Artificial Sequence
  source: /note="Description of Artificial Sequence: Synthetic peptide"
ARTDIVVVPAARGFYFDY

SEQ ID NO: 3207 - protein, 13 aa, Artificial Sequence
  source: /note="Description of Artificial Sequence: Synthetic peptide"
ARESGDTTMAFDY

SEQ ID NO: 3208 - protein, 11 aa, Artificial Sequence
  source: /note="Description of Artificial Sequence: Synthetic peptide"
ARDLGTGLFDY

SEQ ID NO: 3209 - protein, 11 aa, Artificial Sequence
  source: /note="Description of Artificial Sequence: Synthetic peptide"
ARDYGDFYFDY

SEQ ID NO: 3210 - protein, 11 aa, Artificial Sequence
  source: /note="Description of Artificial Sequence: Synthetic peptide"
ARDYGDLYFDY

SEQ ID NO: 3211 - protein, 10 aa, Artificial Sequence
  source: /note="Description of Artificial Sequence: Synthetic peptide"
ATDLTSGRGP

SEQ ID NO: 3212 - protein, 11 aa, Artificial Sequence
  source: /note="Description of Artificial Sequence: Synthetic peptide"
ARDLVVWGMDV

SEQ ID NO: 3213 - protein, 19 aa, Artificial Sequence
  source: /note="Description of Artificial Sequence: Synthetic peptide"
TKPHAHCGGDCYSRDWFDP

SEQ ID NO: 3214 - protein, 17 aa, Artificial Sequence
  source: /note="Description of Artificial Sequence: Synthetic peptide"
AKGLIAELVGGGWYFDY

SEQ ID NO: 3215 - protein, 16 aa, Artificial Sequence
  source: /note="Description of Artificial Sequence: Synthetic peptide"
AKALSSTGFLVVYFDY

SEQ ID NO: 3216 - protein, 22 aa, Artificial Sequence
  source: /note="Description of Artificial Sequence: Synthetic peptide"
AWRYSSSWYTVDNKKGDYYFDY

SEQ ID NO: 3217 - protein, 11 aa, Artificial Sequence
  source: /note="Description of Artificial Sequence: Synthetic peptide"
ARHISSGWYDY

SEQ ID NO: 3218 - protein, 16 aa, Artificial Sequence
  source: /note="Description of Artificial Sequence: Synthetic peptide"
ARHRHPGITMIVALDY

SEQ ID NO: 3219 - protein, 13 aa, Artificial Sequence
  source: /note="Description of Artificial Sequence: Synthetic peptide"
ALTTVTTGRWFDP

SEQ ID NO: 3220 - protein, 132 aa, Artificial Sequence
  source: /note="Description of Artificial Sequence: Synthetic polypeptide"
QVQLQESGPGLVKPSETLSLTCTVSGASVSSGSYYWSWIRQPPGKGLEWIGYIYYSGSTNYNPSLKSRVTISVDTSKNQFSLKLSSVTAADTAVYYCARERPGGTYSNTWYTPTDTNWFDTWGQGTLVTVSS

SEQ ID NO: 3221 - protein, 132 aa, Artificial Sequence; identical to SEQ ID NO: 3220
  source: /note="Description of Artificial Sequence: Synthetic polypeptide"

SEQ ID NO: 3222 - protein, 128 aa, Artificial Sequence
  source: /note="Description of Artificial Sequence: Synthetic polypeptide"
EVQLVQSGAEVKKPGESLKISCKGSGYRFTSYWIGWVRQMPGKGLEWMGIIYPGDSDATYSPSFQGQVTISADRSISTAYLQWSSLKASDTAMYYCARSFRDDPRIAVAGPADAFDIWGQGTMVTVSS

SEQ ID NO: 3223 - protein, 128 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISTAYMQWSSLKASDTAMYYCARSFRDDPRIAVAGPADAFDIWGQGTMVTVSS

SEQ ID NO: 3224 - protein, 122 aa, Artificial Sequence
  source: /note="Description of Artificial Sequence: Synthetic polypeptide"
QVQLVQSGAEVKKPGASVKVSCKASGYTFTSYGFSWVRQAPGQGLEWLGWISAYNGNTNYAQKLQGRVTMTTDTSTSTAYMELRSLRSDDTAVYYCARAIAVAGTSGEFDYWGQGTLVTVSS

SEQ ID NO: 3225 - protein, 119 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSQGWLQLNDYWGQGTLVTVSS

SEQ ID NO: 3226 - protein, 123 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTKYAQKFQGRVTMTRDTSISTAYMELSRLRSDDTAVYYCARGHDYVWGSYRYHNVWGQGTLVTVSS

SEQ ID NO: 3227 - protein, 122 aa, Artificial Sequence
  source: /note="Description of Artificial Sequence: Synthetic polypeptide"
QVQLVQSGAEVKKPGASVMLSCKASGYTFTGYYMHWVRQAPGQGLEWMGWINPNSGGTNYAQKFQGRVTMTRDTSITTTYMELSRLRSDDTAVYYCARDLAFSMVRAPGDYWGQGTLVTVSS

SEQ ID NO: 3228 - protein, 120 aa, Artificial Sequence
  source: /note="Description of Artificial Sequence: Synthetic polypeptide"
QVQLVQSGAEVKKPGASVKVSCKASGYTFTGYSMHWVRQAPGQGLEWMGWINPNSGGTNYAQKFQGRVTMTRDTSISTAYMELNRLRSDDTAVYYCARELIAVAGIFDYWGQGTLVTVSS

SEQ ID NO: 3229 - protein, 129 aa, Artificial Sequence; identical to SEQ ID NO: 85
  source: /note="Description of Artificial Sequence: Synthetic polypeptide"

SEQ ID NO: 3230 - protein, 125 aa, Artificial Sequence
  source: /note="Description of Artificial Sequence: Synthetic polypeptide"
QVQLVQSGAEVKKPGASVKVSCKASGYILTDYFIHWVRQAPGQGLEWMGWINPNSGGTNYAQKFQGRVTMTRDTSISTAYMELSRLRSDDTAVYHCARYKGTTVNTNYYYGMDVWGQGTTVTVSS

SEQ ID NO: 3231 - protein, 126 aa, Artificial Sequence
  source: /note="Description of Artificial Sequence: Synthetic polypeptide"
QVQLVQSGAEVKKPGASVKVSCKASGYSFTSYYMHWVRQAPGQGLEWMGIINPSGGSTSYAQKFQGRVTMTRDTSTSTVYMELSSLRSEDTAVYYCARDPSPIIARPGMGYWFDPWGQGTLVTVSS

SEQ ID NO: 3232 - protein, 123 aa, Artificial Sequence
  source: /note="Description of Artificial Sequence: Synthetic polypeptide"
QVQLVQSGAEVKKPGSSVKVSCKASGGTFRSYAISWVRQAPGQGLEWMGGIIPIFGTTNYAQKFQGRVTITADESTSRAYMELSSLRSEDTAVYYCARDSSGYYYVSNWFDPWGQGTLVTVSS

SEQ ID NO: 3233 - protein, 18 aa, Artificial Sequence
  source: /note="Description of Artificial Sequence: Synthetic peptide"
GGGGSGGGGSHHHHHHHH

SEQ ID NO: 3234 - protein, 15 aa, Artificial Sequence
  source: /note="Description of Artificial Sequence: Synthetic peptide"
GLNDIFEAQKIEWHE

SEQ ID NO: 3235 - protein, 4 aa, Severe acute respiratory syndrome coronavirus 2
RRAR

SEQ ID NO: 3236 - protein, 4 aa, Artificial Sequence
  source: /note="Description of Artificial Sequence: Synthetic peptide"
GSAS

SEQ ID NO: 3237 - protein, 13 aa, Artificial Sequence
  source: /note="Description of Artificial Sequence: Synthetic peptide"
IKGSGRENLYFQG

SEQ ID NO: 3238 - protein, 31 aa, Artificial Sequence
  source: /note="Description of Artificial Sequence: Synthetic polypeptide"
GGGSGYIPEAPRDGQAYVRKDGEWVLLSTFL

SEQ ID NO: 3239 - protein, 9 aa, Artificial Sequence
  source: /note="Description of Artificial Sequence: Synthetic peptide"
GHHHHHHHH

SEQ ID NO: 3240 - protein, 11 aa, Artificial Sequence
  source: /note="Description of Artificial Sequence: Synthetic peptide"
GSGRENLYFQG

SEQ ID NO: 3241 - protein, 6 aa, Artificial Sequence
  source: /note="Description of Artificial Sequence: Synthetic 6xHis tag"
HHHHHH

SEQ ID NO: 3242 - DNA, 869 bp, Artificial Sequence
  source: /note="Description of Artificial Sequence: Synthetic polynucleotide"
  modified_base (700)..(700): a, c, t, g, unknown or other
  modified_base (796)..(796): a, c, t, g, unknown or other
  modified_base (798)..(798): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccggggacacggccgtgtattactgtgcgagggattacggtgacttctactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgcccagcacctgaact

SEQ ID NO: 3243 - DNA, 405 bp, Artificial Sequence
  source: /note="Description of Artificial Sequence: Synthetic polynucleotide"
  modified_base (399)..(399): a, c, t, g, unknown or other
gaggtgctcttggaggagggtgccagggggaagaccgatgggcccttggtggaggctgaggagacggtgaccagggttccctggccccagtagtcaaagtagaagtcaccgtaatccctcgcacagtaatacacggccgtgtccccggctctcaggctgttcatttgaagatacagcgtgttcttggaattgtctctggagatggtgaatcggcccttcacggagtctgcgtagtatgtgctaccaccgctataaataactgagacccactccagccccttccctggagcctggcggacccagctcatgtagttgctactgacggtgaacccagaggctgcacaggagagtctcagggaccccccaggctggatcaagcctcctccagactccaccagnctgcac

SEQ ID NO: 3244 - DNA, 766 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaggacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatc

SEQ ID NO: 3245 - DNA, 451 bp, Artificial Sequence
  source: /note="Description of Artificial Sequence: Synthetic polynucleotide"
cgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccagcttggtcccctggccaaaagtcctaggtgagctaccatactgctgacagtaatacactgcaaaatcttcaggctccagtctgctgatggtgagagtgaagtctgtcccagacccactgccactgaacctgtctgggatgccagtggccctgctggatgcaccatagatgaggagcctgggagcctggccaggtttctgctggtaccaggctaagtaggtgctgctaacactctgactggccctgcaggagagggtggctctttcccctggagacaaagacagggagactgga

SEQ ID NO: 3246 - DNA, 825 bp, Artificial Sequence
  source: /note="Description of Artificial Sequence: Synthetic polynucleotide"
  modified_base (677)..(677): a, c, t, g, unknown or other
  modified_base (728)..(728): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccgtattaaagacaaatctgatggtgggacaatagactacgctgcacccgtgcaaggcagattcaccatctcaagagatgattcaaaaaacacgctgtatctgcaaatgaacagcctgaaaaccgaggacacagccgtgtattactgtaccacaggccctcactatgatgattctggttattcgtacactgttgactactggggccagggaaccctggtcaccgtctcctcagcggtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaa

SEQ ID NO: 3247 - DNA, 434 bp, Artificial Sequence
  source: /note="Description of Artificial Sequence: Synthetic polynucleotide"
  modified_base (1)..(1): a, c, t, g, unknown or other
  modified_base (433)..(433): a, c, t, g, unknown or other
ngaggtgctcttggaggagggtgccagggggaagaccgatgggcccttggtggaggctgaggagacggtgaccagggttccctggccccagtagtcaacagtgtacgaataaccagaatcatcatagtgagggcctgtggtacagtaatacacggctgtgtcctcggttttcaggctgttcatttgcagatacagcgtgttttttgaatcatctcttgagatggtgaatctgccttgcacgggtgcagcgtagtctattgtcccaccatcagatttgtctttaatacggccaacccactccagccccttccctggagcctggcggacccagttcatccaggcgttactgaaagtgaatccagaggctgcacaggagagtctaagggaccccccaggctttaccaagcctcccccagactccaccagctgcacnt

SEQ ID NO: 3248 - DNA, 777 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacatggggatattgtgatgactcagtctccactctccctgcccgtcacccctggagagccggcctccatctcctgcaggtctagtcagagcctcctgcatagtaatggattccactttttggattggtacctgcagaagccagggcagactccacagctcctgatctatgtgggttctaatcgggcctccggggtccctgacaggttcagtggcagtggatcaggcacagattttacattgaaaatcagcagagtggaggctgaggatgttggggtttattactgcatgcaagctctacaaactcccctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccat

SEQ ID NO: 3249 - DNA, 463 bp, Artificial Sequence
  source: /note="Description of Artificial Sequence: Synthetic polynucleotide"
  modified_base (459)..(459): a, c, t, g, unknown or other
cgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccaccttggtccctccgccgaaagtgaggggagtttgtagagcttgcatgcagtaataaaccccaacatcctcagcctccactctgctgattttcaatgtaaaatctgtgcctgatccactgccactgaacctgtcagggaccccggaggcccgattagaacccacatagatcaggagctgtggagtctgccctggcttctgcaggtaccaatccaaaaagtggaatccattactatgcaggaggctctgactagacctgcaggagatggaggccggctctccaggggtgacgggcagggagantgga

SEQ ID NO: 3250 - DNA, 837 bp, Artificial Sequence
  source: /note="Description of Artificial Sequence: Synthetic polynucleotide"
  modified_base (657)..(657): a, c, t, g, unknown or other
  modified_base (707)..(708): a, c, t, g, unknown or other
  modified_base (806)..(806): a, c, t, g, unknown or other
  modified_base (811)..(811): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatttcatatgatggaaggaataaatactatgcagactccgtgaagggccgattcaccatctccagagacaactccaagaacacgctgtatctgcaaatgaacagcctgagagctgaggacacggctgtgtattactgtgcgagagaattcggtgaccccgagtggtactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcngcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccaagntgganagagagttgagcccaaatcttgtgac

SEQ ID NO: 3251 - DNA, 439 bp, Artificial Sequence
  source: /note="Description of Artificial Sequence: Synthetic polynucleotide"
  modified_base (12)..(12): a, c, t, g, unknown or other
  modified_base (429)..(430): a, c, t, g, unknown or other
  modified_base (432)..(432): a, c, t, g, unknown or other
  modified_base (434)..(434): a, c, t, g, unknown or other
cgctgtgccccngaggtgctcttggaggagggtgccagggggaagaccgatgggcccttggtggaggctgaggagacggtgaccagggttccctggccccagtagtcaaagtaccactcggggtcaccgaattctctcgcacagtaatacacagccgtgtcctcagctctcaggctgttcatttgcagatacagcgtgttcttggagttgtctctggagatggtgaatcggcccttcacggagtctgcatagtatttattccttccatcatatgaaataactgtcacccactccagccccttgcctggagcctggcggacccagtgcatgccatagctactgaaggtgaatccagaggctgcacaggagagtctcagggacctcccaggctggaccacgcctcccccagactccaccagctgcacctannangnaaacc

SEQ ID NO: 3252 - DNA, 794 bp, Artificial Sequence
  source: /note="Description of Artificial Sequence: Synthetic polynucleotide"
  modified_base (710)..(710): a, c, t, g, unknown or other
  modified_base (761)..(761): a, c, t, g, unknown or other
  modified_base (764)..(764): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccaatcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgancaaagcagactacgagaaacacaaagtctacgcctgcgaagtcacccatcnggnctgagctcgcccgtcacaaagagcttcaac

SEQ ID NO: 3253 - DNA, 467 bp, Artificial Sequence
  source: /note="Description of Artificial Sequence: Synthetic polynucleotide"
  modified_base (6)..(6): a, c, t, g, unknown or other
  modified_base (448)..(448): a, c, t, g, unknown or other
  modified_base (451)..(451): a, c, t, g, unknown or other
  modified_base (454)..(454): a, c, t, g, unknown or other
  modified_base (456)..(459): a, c, t, g, unknown or other
tgggantacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgattggcccggcaagtgatggtgactctgtctcctacagatgcagacagggngantgnannnnggggtcat

SEQ ID NO: 3254 - DNA, 814 bp, Artificial Sequence
  source: /note="Description of Artificial Sequence: Synthetic polynucleotide"
  modified_base (666)..(667): a, c, t, g, unknown or other
  modified_base (716)..(718): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatgctatgcactgggtccgccaggctccagccaaggggctggagtgggtggcagttatattatatgatggaagcggtaaatactacgcagactccgtgaagggccgattcaccatctccagagacaattccaagaacacgttgtatctgcaaatgaacagcctgagagctgaggacacggctgtgtattactgtgcgagagacgggatcgtggatacagctctggttacgtggtttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcnncgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcaacaccaag

SEQ ID NO: 3255 - DNA, 425 bp, Artificial Sequence
  source: /note="Description of Artificial Sequence: Synthetic polynucleotide"
gaggtgctcttggaggagggtgccagggggaagaccgatgggcccttggtggaggctgaggagacggtgaccagggttccctggccccagtagtcaaaccacgtaaccagagctgtatccacgatcccgtctctcgcacagtaatacacagccgtgtcctcagctctcaggctgttcatttgcagatacaacgtgttcttggaattgtctctggagatggtgaatcggcccttcacggagtctgcgtagtatttaccgcttccatcatataatataactgccacccactccagccccttggctggagcctggcggacccagtgcatagcatagctactgaaggtgaatccagaggctgcacaggagagtctcagggacctcccaggctggaccacgcctcccccagactccaccaggctgcacct

SEQ ID NO: 3256 - DNA, 857 bp, Artificial Sequence
  source: /note="Description of Artificial Sequence: Synthetic polynucleotide"
  modified_base (767)..(767): a, c, t, g, unknown or other
  modified_base (772)..(772): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatcctccctgtctgcatctgtaggagacagagtcaccatcacttgccgggcaagtcagagcattagcacctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggccntgagctcgcccgtcacaaagagcttcaacaggggagagtgttagaagcttggccgccatggcccaacttgtttattgcagcttat

SEQ ID NO: 3257 - DNA, 445 bp, Artificial Sequence
  source: /note="Description of Artificial Sequence: Synthetic polynucleotide"
cgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccacggaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaataggtgctaatgctctgacttgcccggcaagtgatggtgactctgtctcctacagatgcagacagggag

SEQ ID NO: 3258 - DNA, 719 bp, Artificial Sequence
  source: /note="Description of Artificial Sequence: Synthetic polynucleotide"
  modified_base (670)..(670): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtatctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaggggagaccatctgatattgtagtggtggtggcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctc

SEQ ID NO: 3259 - DNA, 436 bp, Artificial Sequence
  source: /note="Description of Artificial Sequence: Synthetic polynucleotide"
  modified_base (2)..(2): a, c, t, g, unknown or other
cnctgtgccccagaggtgctcttggaggagggtgccagggggaagaccgatgggcccttggtggaggctgaggagacggtgaccagggttccctggccccagtagtcaaaggccaccaccactacaatatcagatggtctcccctctttcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagatactgaaggtgaatccagaggctgcacaggagagtctcagggacctcccaggctggaccacgcctcccccagactccaccagctgca

SEQ ID NO: 3260 - DNA, 857 bp, Artificial Sequence
  source: /note="Description of Artificial Sequence: Synthetic polynucleotide"
  modified_base (799)..(799): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacnggggagagtgttagaagcttggccgccatggcccaacttgtttattgcagcttataat

SEQ ID NO: 3261 - DNA, 447 bp, Artificial Sequence
  source: /note="Description of Artificial Sequence: Synthetic polynucleotide"
  modified_base (442)..(442): a, c, t, g, unknown or other
attggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccgaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaatagctgctaatgctctgacttgcccggcaagtgatggtgactctgtctcctacagatgcagacagggagantggag

SEQ ID NO: 3262 - DNA, 910 bp, Artificial Sequence
  source: /note="Description of Artificial Sequence: Synthetic polynucleotide"
  modified_base (670)..(670): a, c, t, g, unknown or other
  modified_base (720)..(721): a, c, t, g, unknown or other
  modified_base (816)..(816): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtatctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaggggagaccatctgatattgtagtggtggtggcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccnaaggtggacaagagagttgagcccaaatcttgtgacaaactcacacatgcccaccgtgcccagcacctgaactcctggggggaccgtcagtctt

SEQ ID NO: 3263 - DNA, 437 bp, Artificial Sequence
  source: /note="Description of Artificial Sequence: Synthetic polynucleotide"
  modified_base (4)..(5): a, c, t, g, unknown or other
  modified_base (8)..(8): a, c, t, g, unknown or other
  modified_base (11)..(12): a, c, t, g, unknown or other
  modified_base (14)..(14): a, c, t, g, unknown or other
  modified_base (28)..(29): a, c, t, g, unknown or other
gctnngcnccnnangtgctcttggaggnnggtgccagggggaagaccgatgggcccttggtggaggctgaggagacggtgaccagggttccctggccccagtagtcaaaggccaccaccactacaatatcagatggtctcccctctttcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagatactgaaggtgaatccagaggctgcacaggagagtctcagggacctcccaggctggaccacgcctcccccagactccaccagcctgcac

SEQ ID NO: 3264 - DNA, 763 bp, Artificial Sequence
  source: /note="Description of Artificial Sequence: Synthetic polynucleotide"
  modified_base (666)..(666): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgagcaaagcagactacgagaaacacaaagtctacgcctgcgaagtcacccatc

SEQ ID NO: 3265 - DNA, 467 bp, Artificial Sequence
  source: /note="Description of Artificial Sequence: Synthetic polynucleotide"
  modified_base (2)..(2): a, c, t, g, unknown or other
  modified_base (7)..(7): a, c, t, g, unknown or other
  modified_base (456)..(456): a, c, t, g, unknown or other
  modified_base (461)..(463): a, c, t, g, unknown or other
cnggganttacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccgaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaatagctgctaatgctctgacttgcccggcaagtgatggtgactctgtctcctacagatgcagacagggagantggannntggg

SEQ ID NO: 3266 - DNA, 869 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctatcagtggtggcacaaactatgcacagaagtttcagggcagggtcaccatgaccagggacacgtccatcagcacagcctacatggagctgagcaggctgagatctgacgacacggccgtgtattactgtgcgagcccagcatcacgtggatatagtggctacgatcatgggtactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaac

SEQ ID NO: 3267 - DNA, 450 bp, Artificial Sequence
  source: /note="Description of Artificial Sequence: Synthetic polynucleotide"
  modified_base (29)..(29): a, c, t, g, unknown or other
gctgtgccccagaggtgctcttggagganggtgccagggggaagaccgatgggcccttggtggaggctgaggagacggtgaccgtggtccctttgccccagacgtccatgtagtagtagtacccatgatcgtagccactatatccacgtgatgctgggctcgcacagtaatacacggccgtgtcgtcagatctcagcctgctcagctccatgtaggctgtgctgatggacgtgtccctggtcatggtgaccctgccctgaaacttctgtgcatagtttgtgccaccactgatagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacct

SEQ ID NO: 3268 - DNA, 870 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattgtgccatccggatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaa

SEQ ID NO: 3269 - DNA, 454 bp, Artificial Sequence
  source: /note="Description of Artificial Sequence: Synthetic polynucleotide"
  modified_base (2)..(3): a, c, t, g, unknown or other
  modified_base (7)..(7): a, c, t, g, unknown or other
  modified_base (10)..(10): a, c, t, g, unknown or other
  modified_base (453)..(453): a, c, t, g, unknown or other
cnngganttncccgattggagggcgttatccaccttccactgtactttggcctctctgggatagaagttattcagcaggcacacaacagaggcagttccagatttcaactgctcatcagatggcgggaagatgaagacagatggtgcagccacagttcgtttaatctccagtcgtgtcccttggccgaaggtgatagggagattatcatactgttgacagtaatatgttgcaatatcttcaggctgcaggctgctgatggtgaaagtaaaatctgtcccagatccacttccactgaaccttgatgggacccctgtttccaaattggatgcatcgtagatcaggagcttaggggctttccctggtttctgctgataccaatttaaatagttgctaatgtcctgactcgcctggcaagtgatggtgactctgtctcctacagatgcagacagggng

SEQ ID NO: 3270 - DNA, 813 bp, Artificial Sequence
  source: /note="Description of Artificial Sequence: Synthetic polynucleotide"
  modified_base (667)..(667): a, c, t, g, unknown or other
  modified_base (717)..(719): a, c, t, g, unknown or other
  modified_base (742)..(742): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggctccccattgtagcggtggtagctgccttgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnnctctactccctcagcagcgtggngaccgtgccctccagcagcttgggcacccagacctacatctgcaacgtgaatcacaagcccagcaacacca

SEQ ID NO: 3271 - DNA, 425 bp, Artificial Sequence
  source: /note="Description of Artificial Sequence: Synthetic polynucleotide"
  modified_base (1)..(1): a, c, t, g, unknown or other
ngaggtgctcttggaggagggtgccagggggaagaccgatgggcccttggtggaggctgaagagacggtgaccattgtcccttggccccagatatcaaaagcatcaaggcagctaccaccgctacaatggggagccgcacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcacagcagagctagtaaaggtgaatccagaagccttgcaggagaccttcactgaggtcccaggcttcttcacctcaggcccagactgcaccagctgcacct

SEQ ID NO: 3272 - DNA, 765 bp, Artificial Sequence
  source: /note="Description of Artificial Sequence: Synthetic polynucleotide"
  modified_base (668)..(669): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagaagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcnnacagcaaggacagcacctacagcctcagcagcaccctgacgctgagcaaagcagactacgagaaacacaaagtctacgcctgcgaagtcacccatc

SEQ ID NO: 3273 - DNA, 458 bp, Artificial Sequence
  source: /note="Description of Artificial Sequence: Synthetic polynucleotide"
  modified_base (2)..(2): a, c, t, g, unknown or other
anttacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccacggtgagctaccatactgctgacagtaatacactgcaaaatcttcaggctccagtctgctgatggtgagagtgaagtctgtcccagacccactgccactgaacctgtctgggatgccagtggccctgctggatgcaccatagatgaggagcctgggagcctggccaggtttctgctggtaccaggctaagtagctgcttctaacactctgactggccctgcaggagagggtggctctttcccctggagacaaagacagggagactgga

SEQ ID NO: 3274 - DNA, 880 bp, Artificial Sequence
  source: /note="Description of Artificial Sequence: Synthetic polynucleotide"
  modified_base (723)..(725): a, c, t, g, unknown or other
  modified_base (822)..(822): a, c, t, g, unknown or other
  modified_base (827)..(827): a, c, t, g, unknown or other
  modified_base (831)..(831): a, c, t, g, unknown or other
  modified_base (853)..(853): a, c, t, g, unknown or other
  modified_base (862)..(862): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcttggtcaagcctggagggtccctgagactctcctgtgcagcctctggattcatcttcagtgactactgcatgagctggatccgccgggctccagggaaggggctggaatggctttcatatattagtaatagtggtaccaccagatactacgcagactctgtgaagggccgattcaccatctccagggacaacggcaggaactcactgtatctgcaaatggacagcctgagcgccgaagacacggccgtttattactgtgcgagaaggggggacggtagcagctcgatctactactacaactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcaacaccaagnggacnaganagttgagcccaaatcttgtganaaactcacncatgcccaccgtgcccag

SEQ ID NO: 3275 - DNA, 443 bp, Artificial Sequence
  source: /note="Description of Artificial Sequence: Synthetic polynucleotide"
  modified_base (2)..(3): a, c, t, g, unknown or other
  modified_base (9)..(14): a, c, t, g, unknown or other
gnngctgtnnnnnngaggtgctcttggaggagggtgccagggggaagaccgatgggcccttggtggaggctgaggagacggtgaccgtggtccctttgccccagacgtccatgtagttgtagtagtagatcgagctgctaccgtccccccttctcgcacagtaataaacggccgtgtcttcggcgctcaggctgtccatttgcagatacagtgagttcctgccgttgtccctggagatggtgaatcggcccttcacagagtctgcgtagtatctggtggtaccactattactaatatatgaaagccattccagccccttccctggagcccggcggatccagctcatgcagtagtcactgaagatgaatccagaggctgcacaggagagtctcagggaccctccaggcttgaccaagcctcccccagactccaccagcctgcac

SEQ ID NO: 3276 - DNA, 880 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccaccctcagcgtctgggacccccggacagagggtcaccgtctcttgttctggaagcagctccaacatcggaagcaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattatttctgtgcagcatgggatgacagcctgaatggtccggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaa

SEQ ID NO: 3277 - DNA, 381 bp, Artificial Sequence
  source: /note="Description of Artificial Sequence: Synthetic polynucleotide"
  modified_base (2)..(3): a, c, t, g, unknown or other
  modified_base (21)..(21): a, c, t, g, unknown or other
  modified_base (354)..(354): a, c, t, g, unknown or other
  modified_base (367)..(369): a, c, t, g, unknown or other
  modified_base (371)..(372): a, c, t, g, unknown or other
gnnagccttgggctgacctangacggtcagcttggtccctccgccgaataccggaccattcaggctgtcatcccatgctgcacagaaataatcagcctcatcctcagactggagcccactgatggccagggaggctgaggtgccagacttggagccagagaatcggtcagggacccctgagggccgctgattattactatagatgaggagtttgggggccgttcctgggagctgctggtaccagtttacagtattgcttccgatgttggagctgcttccagaacaagagacggtgaccctctgtccgggggtcccagacgctgagggtggctgagtcagcacagactgggcccnggaaccggttgcnnntnncttactaga

SEQ ID NO: 3278 - DNA, 872 bp, Artificial Sequence
  source: /note="Description of Artificial Sequence: Synthetic polynucleotide"
  modified_base (664)..(664): a, c, t, g, unknown or other
  modified_base (714)..(715): a, c, t, g, unknown or other
  modified_base (811)..(813): a, c, t, g, unknown or other
  modified_base (817)..(817): a, c, t, g, unknown or other
  modified_base (819)..(819): a, c, t, g, unknown or other
  modified_base (861)..(861): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtctcctgcatggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagactccccatttagtgctttaggggcctccaatgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccannnggananagagttgagcccaaatcttgtgacaaaactcacacatgcccnccgtgcccagc

SEQ ID NO: 3279 - DNA, 438 bp, Artificial Sequence
  source: /note="Description of Artificial Sequence: Synthetic polynucleotide"
  modified_base (425)..(426): a, c, t, g, unknown or other
  modified_base (428)..(429): a, c, t, g, unknown or other
  modified_base (435)..(435): a, c, t, g, unknown or other
cagaggtgctcttggaggagggtgccagggggaagaccgatgggcccttggtggaggctgaggagacggtgaccagggttccctggccccagtagtcattggaggcccctaaagcactaaatggggagtctctcgcacagtaatacacggccgtgtcgtcagatctcagcctgctcagctccatgtaggctgtgctgatggacgtgtccctggtcatggtgaccctgccctgaaacttctgtgcatagtttgtgccaccactgttagggttgatccatcccatccactcaagcccttgtccaggggcctgtcgcacccagtgcatatagtagccggtgaaggtgtatccagaagccatgcaggagaccttcactgaggccccaggcttcttcacctcagccccagactgcaccagctgcacctgnnanngggacnccc

SEQ ID NO: 3280 - DNA, 872 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgagtattactgcagctcagatgcaggcagcaacaatgtggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaa

SEQ ID NO: 3281 - DNA, 332 bp, Artificial Sequence
  source: /note="Description of Artificial Sequence: Synthetic polynucleotide"
ttgggctgacctaggacggtcagcttggtccctccgccgaataccacattgttgctgcctgcatctgagctgcagtaatactcagcctcatcctcagcctggagcccagagacggtcagggaggccgtgttgccagacttggagccagagaagcgatcagggacccctgagggccgcttactgacctcataaatcatgagtttgggggctttgcctgggtgctgttggtaccaggagacatagttataaccaccaacgtcactgctggttccagtgcaggagatggtgactgactgtccaggagacccggacgcggagggaggctgagtcag

SEQ ID NO: 3282 - DNA, 822 bp, Artificial Sequence
  source: /note="Description of Artificial Sequence: Synthetic polynucleotide"
  modified_base (665)..(665): a, c, t, g, unknown or other
  modified_base (715)..(717): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgccaaccggtgtacattcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcagaaactatacacagaagtttcagggcagggtcaccatgaccagggacacgtccatcagcacagcctacatggagctgagcaggctgagatctgacgacacggccgtatattactgtgcgagagatctcggatacagctatgtccaagggtactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcaacaccaaggtggacaga

SEQ ID NO: 3283 - DNA, 437 bp, Artificial Sequence
  source: /note="Description of Artificial Sequence: Synthetic polynucleotide"
  modified_base (2)..(3): a, c, t, g, unknown or other
  modified_base (8)..(9): a, c, t, g, unknown or other
  modified_base (11)..(18): a, c, t, g, unknown or other
  modified_base (24)..(24): a, c, t, g, unknown or other
  modified_base (30)..(33): a, c, t, g, unknown or other
  modified_base (97)..(97): a, c, t, g, unknown or other
gnncgctnngnnnnnnnngtgctnttggannnnggtgccagggggaagaccgatgggcccttggtggaggctgaggagacggtgaccagggttcccnggccccagtagtcaaagtacccttggacatagctgtatccgagatctctcgcacagtaatatacggccgtgtcgtcagatctcagcctgctcagctccatgtaggctgtgctgatggacgtgtccctggtcatggtgaccctgccctgaaacttctgtgtatagtttctgccaccactgttagggttgatccatcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctg

SEQ ID NO: 3284 - DNA, 787 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgagtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtaacacttgggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtgg

SEQ ID NO: 3285 - DNA, 381 bp, Artificial Sequence
  source: /note="Description of Artificial Sequence: Synthetic polynucleotide"
  modified_base (2)..(2): a, c, t, g, unknown or other
  modified_base (367)..(370): a, c, t, g, unknown or other
  modified_base (372)..(374): a, c, t, g, unknown or other
gncagccttgggctgacctaggacggtcagcttggtccctccgccgaacacccaagtgttactacctgcatatgagcagcagtaataatcagcctcgtcctcagcctggagcccagagattgtcagggaggccgtgttgccagacttggagccagagaagcgattagaaacccctgagggccgcttactgccctcataaatcatgagtttgggggctttgcctgggtgctgttggtaccaggagacaaggttataactcccaacatcactgctggttccagtgcaggagatggtgatcgactgtccaggagacccagactcggaggcaggctgagtcagcacagactgggaccaggaaccggttgcnnnngnnnaactaga

SEQ ID NO: 3286 - DNA, 860 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagggaatcgactactttattgtagtagtaccagctgctatctagatgcggttaggcaggggtactactactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaa

SEQ ID NO: 3287 - DNA, 485 bp, Artificial Sequence
  source: /note="Description of Artificial Sequence: Synthetic polynucleotide"
  modified_base (3)..(3): a, c, t, g, unknown or other
  modified_base (7)..(7): a, c, t, g, unknown or other
ggncgcngtgccccagaggtgctcttggaggagggtgccagggggaagaccgatgggcccttggtggaggctgaggagacggtgaccgtggtccctttgccccagacgtccatgtagtagtagtagtagtacccctgcctaaccgcatctagatagcagctggtactactacaataaagtagtcgattccctctcgcacagtaatacacggccgtgtcctcagatctcaggctgctcagctccatgtaggctgtgctcgtggattcgtccgcggtaatcgtgactctgccctggaacttctgtgcgtagtttgctgtaccaaagatagggatgatccctcccatccactcaagcccttgtccaggggcctgtcgcacccagctgatagcatagctgctgaaggtgcctccagaagccttgcaggagaccttcaccgaggacccaggcttcttcacctcagccccagactgcaccagctggcacct

SEQ ID NO: 3288 - DNA, 859 bp, Artificial Sequence
  source: /note="Description of Artificial Sequence: Synthetic polynucleotide"
  modified_base (54)..(58): a, c, t, g, unknown or other
  modified_base (60)..(60): a, c, t, g, unknown or other
  modified_base (664)..(665): a, c, t, g, unknown or other
  modified_base (711)..(711): a, c, t, g, unknown or other
  modified_base (719)..(719): a, c, t, g, unknown or other
  modified_base (762)..(765): a, c, t, g, unknown or other
  modified_base (803)..(803): a, c, t, g, unknown or other
  modified_base (805)..(805): a, c, t, g, unknown or other
  modified_base (811)..(811): a, c, t, g, unknown or other
  modified_base (840)..(840): a, c, t, g, unknown or other
  modified_base (852)..(852): a, c, t, g, unknown or other
tacacatacgatttaggtgacactatagaataacatccactttgcctttctctnnnnngngtccactcccaggtccaactgcacctcggttctatcgattgaattccaccatgggatggtcatgtatcatcctttttctagtagcaactgcaaccggtgtacattcagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcccctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcnnacagcaaggacagcacctacagcctcagcagcaccctgacgctgancaaagcanactacgagaaacacaaagtctacgcctgcgaagtcacccatcnnnnctgagctcgcccgtcacaaagagcttcaacaggggganantgttanaagcttggccgccatggcccaacttgttnattgcagcttanatggtta

SEQ ID NO: 3289 - DNA, 440 bp, Artificial Sequence
  source: /note="Description of Artificial Sequence: Synthetic polynucleotide"
cgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccaccttggtccctccgccgaaagtgaggggccagttgctacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacaggg

SEQ ID NO: 3290 - DNA, 878 bp, Artificial Sequence
  source: /note="Description of Artificial Sequence: Synthetic polynucleotide"
  modified_base (840)..(842): a, c, t, g, unknown or other
  modified_base (844)..(845): a, c, t, g, unknown or other
  modified_base (847)..(847): a, c, t, g, unknown or other
  modified_base (849)..(849): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtgcacagcagtgggggaggcttggtgcaacctggtggctcattgcgcctcagctgcgcggcgtccggcttcaatttttccactcactggatgcattgggtcaggcaagcaccgggaaagggcctcgtgtgggtatctcggattaactccgatggcagcagaagagcctacgctacctcagtgaaagggaggttcacaatttcacgggataacgcaaaaaacactctctatctccagatggactcactccgcgacgaagatacagctgtctattactgtactagggatgatagttcttggccgcatttcttcgacaactggggtcaggggaccttggtgacggtctctagcgcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccnnncnngngnccagcacctgaactcctggggggaccgtc

SEQ ID NO: 3291 - DNA, 375 bp, Artificial Sequence
  source: /note="Description of Artificial Sequence: Synthetic polynucleotide"
ggggccaccggtgtgcacagcagtgggggaggcttggtgcaacctggtggctcattgcgcctcagctgcgcggcgtccggcttcaatttttccactcactggatgcattgggtcaggcaagcaccgggaaagggcctcgtgtgggtatctcggattaactccgatggcagcagaagagcctacgctacctcagtgaaagggaggttcacaatttcacgggataacgcaaaaaacactctctatctccagatggactcactccgcgacgaagatacagctgtctattactgtactagggatgatagttcttggccgcatttcttcgacaactggggtcaggggaccttggtgacggtctctagcgcgtcgacggca

SEQ ID NO: 3292 - DNA, 867 bp, Artificial Sequence
  source: /note="Description of Artificial Sequence: Synthetic polynucleotide"
  modified_base (632)..(632): a, c, t, g, unknown or other
  modified_base (796)..(796): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgatatgtgatattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctgnaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaaggagcaccgtgganaagacagtggcccctacagaatgttcatagaagcttggccgccatggcccaacttgtttattgcagcttat

SEQ ID NO: 3293 - DNA, 366 bp, Artificial Sequence
  source: /note="Description of Artificial Sequence: Synthetic polynucleotide"
  modified_base (353)..(353): a, c, t, g, unknown or other
  modified_base (365)..(365): a, c, t, g, unknown or other
cttgggctgacctaggacggtcagcttggtccctccgccgaatatcacatatcgagagtgctgctgcttgtatatgagctgcagtaataatcagcctcgtcctcagcctggagcccagagatggtcagggaggccgtgttgccagacttggagccagagaagcgattagaaacccctgagggccgattactgacatcataaatcatgagtttgggggctttgcctgggtgttgttggtaccaggagacatagttataaccaccaacgtcactgctggttccagtgcaggagatggtgatcgactgtccaggagacccagacacggaggcaggctgagtcagcacagactgggnccaggaaccggnt

SEQ ID NO: 3294 - DNA, 867 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtgcacagcgtctggagggggcttggtgaaacctggtggttctcttaggctgagttgcgctgcgtcaggctttaccttttcttcttatagcatgaactgggtacgccaagcgccgggcaaaggtctcgagtgggtgtcctctatatcaagttccagtagctacatttactatgctgactcagtcaaaggcagatttaccatcagccgcgataatgccaaaaattcactctatctgcaaatgaactctcttcgcgcagaggataccgctgtctactactgtgctagggaggtgaaaagagtagtagctgccccagagtactactttgattattggggtcaagggacacttgttacagtctcatccgcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacc

SEQ ID NO: 3295 - DNA, 388 bp, Artificial Sequence
  source: /note="Description of Artificial Sequence: Synthetic polynucleotide"
ggggccaccggtgtgcacagcgtctggagggggcttggtgaaacctggtggttctcttaggctgagttgcgctgcgtcaggctttaccttttcttcttatagcatgaactgggtacgccaagcgccgggcaaaggtctcgagtgggtgtcctctatatcaagttccagtagctacatttactatgctgactcagtcaaaggcagatttaccatcagccgcgataatgccaaaaattcactctatctgcaaatgaactctcttcgcgcagaggataccgctgtctactactgtgctagggaggtgaaaagagtagtagctgccccagagtactactttgattattggggtcaagggacacttgttacagtctcatccgcgtcgacggca

SEQ ID NO: 3296 - DNA, 872 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccaccctcagcgtctgggacccccggacagagggtcaccatctcttgttctggaatcagctccaacctcggaagtaatactgttaactggttccagcagctcccaggaacggcccccaaactcctcatttacaatagtaatcggcggccctcaggggtccctgaccgattctctggctccaagtctggcacctcagcctccctggccatcagtgggctccagtctgaggatgagggtgactattactgtgcagaatgggatgacagcctgagtacttgggtgttcggtggagggacccacctgaccgtcctacgtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaa

SEQ ID NO: 3297 - DNA, 367 bp, Artificial Sequence
  source: /note="Description of Artificial Sequence: Synthetic polynucleotide"
  modified_base (4)..(8): a, c, t, g, unknown or other
gggnnnnncttgggctgacgtaggacggtcaggtgggtccctccaccgaacacccaagtactcaggctgtcatcccattctgcacagtaatagtcaccctcatcctcagactggagcccactgatggccagggaggctgaggtgccagacttggagccagagaatcggtcagggacccctgagggccgccgattactattgtaaatgaggagtttgggggccgttcctgggagctgctggaaccagttaacagtattacttccgaggttggagctgattccagaacaagagatggtgaccctctgtccgggggtcccagacgctgagggtggctgagtcagcacagactgggaccaggaaccggttg

SEQ ID NO: 3298 - DNA, 825 bp, Artificial Sequence
  source: /note="Description of Artificial Sequence: Synthetic polynucleotide"
  modified_base (679)..(679): a, c, t, g, unknown or other
  modified_base (729)..(730): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagatatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagtgaccgccccttattgtagtggtggtagctgctacggaggtaactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacacca

SEQ ID NO: 3299 - DNA, 446 bp, Artificial Sequence
  source: /note="Description of Artificial Sequence: Synthetic polynucleotide"
  modified_base (7)..(10): a, c, t, g, unknown or other
  modified_base (439)..(440): a, c, t, g, unknown or other
gctgtgnnnnagaggtgctcttggaggagggtgccagggggaagaccgatgggcccttggtggaggctgaggagacggtgaccagggttccctggccccagtagtcaaagttacctccgtagcagctaccaccactacaataaggggcggtcactttcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatatctactgaaggtgaatccagaggctgcacaggagagtctcagggacctcccaggctggaccacgcctcccccagactccaccannctgcac

SEQ ID NO: 3300 - DNA, 859 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattgtgccatccggatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagcggaagtggatctgggacagattttactttcaccatcaacagcctgcagcctgaagatattgcaacatattactgtcaacagtatgataatctccctcctactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatgg

SEQ ID NO: 3301 - DNA, 446 bp, Artificial Sequence
  source: /note="Description of Artificial Sequence: Synthetic polynucleotide"
  modified_base (2)..(2): a, c, t, g, unknown or other
  modified_base (445)..(445): a, c, t, g, unknown or other
tncccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccaccttggtccctccgccgaaagtaggagggagattatcatactgttgacagtaatatgttgcaatatcttcaggctgcaggctgttgatggtgaaagtaaaatctgtcccagatccacttccgctgaaccttgatgggacccctgtttccaaattggatgcatcgtagatcaggagcttaggggctttccctggtttctgctgataccaatttaaatagttgctaatgtcctgactcgcctggcaagtgatggtgactctgtctcctacagatgcagacagggng

SEQ ID NO: 3302 - DNA, 824 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtaccataggctatgcggactctgtgaagggccgattcaccatctccagagacaacgccaagaactccctgtatctgcaaatgaacagtctgagagctgaggacacggccttttattactgtgcaaaagcgggcgtaaggggtatagcagcagctggtcccgacctcaacttcgaccactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaa

SEQ ID NO: 3303 - DNA, 432 bp, Artificial Sequence
  source: /note="Description of Artificial Sequence: Synthetic polynucleotide"
  modified_base (423)..(426): a, c, t, g, unknown or other
gaggtgctcttggaggagggtgccagggggaagaccgatgggcccttggtggaggctgaggagacggtgaccagggttccctggccccagtggtcgaagttgaggtcgggaccagctgctgctataccccttacgcccgcttttgcacagtaataaaaggccgtgtcctcagctctcagactgttcatttgcagatacagggagttcttggcgttgtctctggagatggtgaatcggcccttcacagagtccgcatagcctatggtaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccacnnnnttgcac

SEQ ID NO: 3304 - DNA, 879 bp, Artificial Sequence
  source: /note="Description of Artificial Sequence: Synthetic polynucleotide"
  modified_base (752)..(752): a, c, t, g, unknown or other
  modified_base (809)..(809): a, c, t, g, unknown or other
  modified_base (842)..(842): a, c, t, g, unknown or other
  modified_base (847)..(847): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggcctgagctcgcccgtcacaaagagcttcaacaggggagagtgttagaagcttggncgccatggcccaacttgtttattgcagcttatnatggntacaaataaagcaatagcatcacaaatttcac

SEQ ID NO: 3305 - DNA, 437 bp, Artificial Sequence
  source: /note="Description of Artificial Sequence: Synthetic polynucleotide"
ccgattggagggcgttatccaccttccactgtactttggcctctctgggatagaagttattcagcaggcacacaacagaggcagttccagatttcaactgctcatcagatggcgggaagatgaagacagatggtgcagccacagttcgtttaatctccagtcgtgtcccttggccgaaggtgatacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggagactgga

SEQ ID NO: 3306 - DNA, 883 bp, Artificial Sequence
  source: /note="Description of Artificial Sequence: Synthetic polynucleotide"
  modified_base (824)..(824): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacttctgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagcgggcgtaaggggtatagcagcagctggtcccgacctcaactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgccc

SEQ ID NO: 3307 - DNA, 441 bp, Artificial Sequence
  source: /note="Description of Artificial Sequence: Synthetic polynucleotide"
ctgtgccccagaggtgctcttggaggagggtgccagggggaagaccgatgggcccttggtggaggctgaggagacggtgaccagggttccctggccccagtagtcaaagttgaggtcgggaccagctgctgctataccccttacgcccgcttttgcacagtaatacaaggccgtgtcctcagctctcagactgttcatttgcagatacagggagttcttggcgttgtctctggagatggtgaatcggcccttcacagagtccgcatagcctatgctaccactattccaactaatacctgagacccactccaggcccttccctggagcttgccggacccagtgcatggcataatcatcaaaggtgaatccagaggctgcacaggagagtctcagggacctgccaggctgtaccaagcctcccccagactccaccagctgcac

SEQ ID NO: 3308 - DNA, 868 bp, Artificial Sequence
  source: /note="Description of Artificial Sequence: Synthetic polynucleotide"
  modified_base (709)..(709): a, c, t, g, unknown or other
  modified_base (752)..(752): a, c, t, g, unknown or other
  modified_base (754)..(754): a, c, t, g, unknown or other
  modified_base (818)..(819): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcanactacgagaaacacaaagtctacgcctgcgaagtcacccatcngncctgagctcgcccgtcacaaagagcttcaacaggggagagtgttagaagcttggccgccatggnncaacttgtttattgcagcttataatggttacaaataaagcaatagcatc

SEQ ID NO: 3309 - DNA, 467 bp, Artificial Sequence
  source: /note="Description of Artificial Sequence: Synthetic polynucleotide"
  modified_base (433)..(433): a, c, t, g, unknown or other
  modified_base (439)..(443): a, c, t, g, unknown or other
  modified_base (465)..(465): a, c, t, g, unknown or other
tacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttaatctccagtcgtgtcccttggccgaaggtgatacgctgctgacagtaataaactgcaaaatcttcaggctctaggctgctgatggtgagagtgaagtctgtcccagacccactgccactgaacctggctgggatgccagtggccctgttggatgcatcatagatgaggagcctgggagcctggccaggtttctgttggtaccaggctaagtagctgctaacactctgactggccctgcaggagagggtggctctttcccctggagacaaagacagggngactgnnnnngggggtcataccaatctcgcangt

SEQ ID NO: 3310 - DNA, 876 bp, Artificial Sequence
  source: /note="Description of Artificial Sequence: Synthetic polynucleotide"
  modified_base (810)..(810): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtaactatgctatacactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattttgacgatagttcgttctgggcgtttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgcccagcacct

SEQ ID NO: 3311 - DNA, 429 bp, Artificial Sequence
  source: /note="Description of Artificial Sequence: Synthetic polynucleotide"
  modified_base (7)..(11): a, c, t, g, unknown or other
  modified_base (422)..(422): a, c, t, g, unknown or other
gctgtgnnnnngaggtgctcttggaggagggtgccagggggaagaccgatgggcccttggtggaggctgaggagacggtgaccagggttccctggccccagtagtcaaacgcccagaacgaactatcgtcaaaatctctcgcacagtaatacacagccgtgtcctcagctctcaggctgttcatttgcagatacagcgtgttcttggaattgtctctggagatggtgaatcggcccttcacggagtctgcgtagtatttattgcttccatcatatgatataactgccacccactccagccccttgcctggagcctggcggacccagtgtatagcatagttactgaaggtgaatccagaggctgcacaggagagtctcagggacctcccaggctggaccacgcctcccccagactccaccagncctgcac

SEQ ID NO: 3312 - DNA, 869 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatcctccctgtctgcgtctgtaggagacagagtcaccatcacttgccgggcaagtcagagcattcgcagctatttaaattggtatcaacagaaaccagggaaagcccctaagctcctgatctatgctgcatccagtttgcaaagtggggtcccttcaaggttcagtggcagtggatctgggacagatttcactctcaccatcagcagtctgcaacctgatgattttgcaacttactactgtcaacagagttacagtacccctccggccacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaa

SEQ ID NO: 3313 - DNA, 455 bp, Artificial Sequence
  source: /note="Description of Artificial Sequence: Synthetic polynucleotide"
  modified_base (3)..(5): a, c, t, g, unknown or other
  modified_base (7)..(7): a, c, t, g, unknown or other
  modified_base (9)..(10): a, c, t, g, unknown or other
  modified_base (453)..(453): a, c, t, g, unknown or other
ggnnntncnngattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccagcttggtcccctggccaaaagtggccggaggggtactgtaactctgttgacagtagtaagttgcaaaatcatcaggttgcagactgctgatggtgagagtgaaatctgtcccagatccactgccactgaaccttgaagggaccccactttgcaaactggatgcagcatagatcaggagcttaggggctttccctggtttctgttgataccaatttaaatagctgcgaatgctctgacttgcccggcaagtgatggtgactctgtctcctacagacgcagacagggngg

SEQ ID NO: 3314 - DNA, 804 bp, Artificial Sequence
  source: /note="Description of Artificial Sequence: Synthetic polynucleotide"
  modified_base (709)..(709): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtttcctgcaaggcatctggatacaccttcaccagttactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagagtgccccgtgaggggaccccagggttcgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacacc

SEQ ID NO: 3315 - DNA, 433 bp, Artificial Sequence
  source: /note="Description of Artificial Sequence: Synthetic polynucleotide"
  modified_base (2)..(2): a, c, t, g, unknown or other
  modified_base (9)..(13): a, c, t, g, unknown or other
  modified_base (431)..(432): a, c, t, g, unknown or other
gncgctgtnnnnnagaggtgctcttggaggagggtgccagggggaagaccgatgggcccttggtggaggctgaggagacggtgaccagggttccctggccccaggggtcgaaccctggggtcccctcacggggcactctagcacagtaatacacggccgtgtcctcagatctcaggctgctcagctccatgtagactgtgctcgtggacgtgtccctggtcatggtgactctgccctggaacttctgtgcgtagcttgtgctaccaccactagggttgattattcccatccactcaagcccttgtccaggggcctgtcgcacccagtgcatatagtaactggtgaaggtgtatccagatgccttgcaggaaaccttcactgaggccccaggcttcttcacctcagccccagactgcaccagctgcacctgnna

SEQ ID NO: 3316 - DNA, 860 bp, Artificial Sequence
  source: /note="Description of Artificial Sequence: Synthetic polynucleotide"
  modified_base (784)..(784): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgacacagccaccctcagtgtcagtggccccaggaaagacggccaggattacctgtggggaaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcaacagggtcgaagccggggatgaggccgactattactgtcaggtgtgggatagtagtagtgatcatgtggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaaagggagcaccgtgganaagacagtggcccctacagaatgttcatagaagcttggccgccatggcccaacttgtttattgcagcttataatgg

SEQ ID NO: 3317 - DNA, 382 bp, Artificial Sequence
  source: /note="Description of Artificial Sequence: Synthetic polynucleotide"
  modified_base (10)..(10): a, c, t, g, unknown or other
  modified_base (367)..(371): a, c, t, g, unknown or other
  modified_base (380)..(381): a, c, t, g, unknown or other
agggggccancttgggctgacctaggacggtcagcttggtccctccgccgaataccacatgatcactactactatcccacacctgacagtaatagtcggcctcatccccggcttcgaccctgttgatggtcagggtggccgtgttcccagagttggagccagagaatcgctcagggatccctgagggccggtcgctatcataatagatgaccagcacaggggcctggcctggcttctgctggtaccagtgcacacttttacttccaatgttgttttccccacaggtaatcctggccgtctttcctggggccactgacactgagggtggctgagtcagcacagactgggcccaggaaccggttgcagnnnnntactaaaanng

SEQ ID NO: 3318 - DNA, 841 bp, Artificial Sequence
  source: /note="Description of Artificial Sequence: Synthetic polynucleotide"
  modified_base (745)..(745): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaaacctggggcctcagtgaaggtttcctgcaaggcatctggatacaccttcaccagctactatatgcactgggtgcgacaggcccctggacaagggcttgagtggatgggaataatcaaccctagtggtggtagcacaacctacgcacagaagttccagggcagagtcaccatgaccagggacacgtccacgagcacagtctacatggagctgagcagcctgagatctgaggacacggccgtgtattactgtgctagagatcgggccgagaccgagggatcggaaacgtattactatgatagtagtggttattacctattggggtactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacacca

SEQ ID NO: 3319 - DNA, 478 bp, Artificial Sequence
  source: /note="Description of Artificial Sequence: Synthetic polynucleotide"
  modified_base (2)..(2): a, c, t, g, unknown or other
  modified_base (9)..(13): a, c, t, g, unknown or other
  modified_base (465)..(467): a, c, t, g, unknown or other
  modified_base (472)..(472): a, c, t, g, unknown or other
gncgctgtnnnnnagaggtgctcttggaggagggtgccagggggaagaccgatgggcccttggtggaggctgaggagacggtgaccagggttccctggccccagtaccccaataggtaataaccactactatcatagtaatacgtttccgatccctcggtctcggcccgatctctagcacagtaatacacggccgtgtcctcagatctcaggctgctcagctccatgtagactgtgctcgtggacgtgtccctggtcatggtgactctgccctggaacttctgtgcgtaggttgtgctaccaccactagggttgattattcccatccactcaagcccttgtccaggggcctgtcgcacccagtgcatatagtagctggtgaaggtgtatccagatgccttgcaggaaaccttcactgaggccccaggtttcttcacctcagccccagactgcaccagctgcaccnnngacangacccc

SEQ ID NO: 3320 - DNA, 880 bp, Artificial Sequence
  source: /note="Description of Artificial Sequence: Synthetic polynucleotide"
  modified_base (119)..(119): a, c, t, g, unknown or other
  modified_base (122)..(122): a, c, t, g, unknown or other
tacacatacgatttaggtgacacttatagaataacatccactttgcctttctctccacaggtgtccactcccaggtccaactgcacctcggttctatcgattgaattccaccatggganggncatgtatcatcctttttctagtagcaactgcaaccggtgtacattccctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccaccgtcgttcggccaagggaccaaggtggaaatcaaacggtggaggcaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatag

SEQ ID NO: 3321 - DNA, 354 bp, Artificial Sequence
  source: /note="Description of Artificial Sequence: Synthetic polynucleotide"
ggggccaccggtgtacattccctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccaccgtcgttcggccaagggaccaaggtggaaatcaaacggtggaggcaccaagctggaaatcaaacgtacgggca

SEQ ID NO: 3322 - DNA, 881 bp, Artificial Sequence
  source: /note="Description of Artificial Sequence: Synthetic polynucleotide"
  modified_base (667)..(667): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagtttggcaatactatgatagtagtggttcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacc

SEQ ID NO: 3323 - DNA, 435 bp, Artificial Sequence
  source: /note="Description of Artificial Sequence: Synthetic polynucleotide"
  modified_base (7)..(11): a, c, t, g, unknown or other
gctgtgnnnnngaggtgctcttggaggagggtgccagggggaagaccgatgggcccttggtggaggctgaggagacggtgaccagggttccctggccccagtagtcaaaggaaccactactatcatagtattgccaaactctcgcacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtgcaggtgagggacagggtctgtgaaggcttcaccagtcctgggcccgactcctgcagctgcacct

SEQ ID NO: 3324 - DNA, 873 bp, Artificial Sequence
  source: /note="Description of Artificial Sequence: Synthetic polynucleotide"
  modified_base (728)..(728): a, c, t, g, unknown or other
  modified_base (779)..(779): a, c, t, g, unknown or other
  modified_base (805)..(805): a, c, t, g, unknown or other
  modified_base (819)..(819): a, c, t, g, unknown or other
  modified_base (821)..(821): a, c, t, g, unknown or other
  modified_base (827)..(827): a, c, t, g, unknown or other
  modified_base (836)..(836): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacatggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgancaaagcagactacgagaaacacaaagtctacgcctgcgaagtcacccatcnggcctgagctcgcccgtcacaaagancttcaacagggganantgttanaagcttggncgccatggcccaacttgtttattgcagcttataatgg

SEQ ID NO: 3325 - DNA, 467 bp, Artificial Sequence
  source: /note="Description of Artificial Sequence: Synthetic polynucleotide"
  modified_base (2)..(3): a, c, t, g, unknown or other
tnnccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatatccactttggtcccagggccgaaagtgaatggagtttgtagagcttgcatgcagtaataaaccccaacatcctcagcctccactctgctgattttcagtgtaaaatctgtgcctgatccactgccactgaacctgtcagggaccccggaggcccgattagaacccaaatagatcaggagctgtggagactgccctggcttctgcaggtaccaatccaaatagttgtatccattactatgcaggaggctctgactagacctgcaggagatggaggccggctctccaggggtgacgggcagggaggatgga

SEQ ID NO: 3326 - DNA, 881 bp, Artificial Sequence
  source: /note="Description of Artificial Sequence: Synthetic polynucleotide"
  modified_base (816)..(816): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaacaatgtattactatgatagtagtggttcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgcccagcacc

SEQ ID NO: 3327 - DNA, 435 bp, Artificial Sequence
  source: /note="Description of Artificial Sequence: Synthetic polynucleotide"
  modified_base (4)..(5): a, c, t, g, unknown or other
  modified_base (431)..(432): a, c, t, g, unknown or other
gctnngccccagaggtgctcttggaggagggtgccagggggaagaccgatgggcccttggtggaggctgaggagacggtgaccagggttccctggccccagtagtcaaaggaaccactactatcatagtaatacattgttctcgcacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtgcaggtgagggacagggtctgtgaaggcttcaccagtcctgggcccgactcctgcagcttnnacc

SEQ ID NO: 3328 - DNA, 873 bp, Artificial Sequence
  source: /note="Description of Artificial Sequence: Synthetic polynucleotide"
  modified_base (728)..(728): a, c, t, g, unknown or other
  modified_base (779)..(779): a, c, t, g, unknown or other
  modified_base (782)..(782): a, c, t, g, unknown or other
  modified_base (813)..(813): a, c, t, g, unknown or other
  modified_base (819)..(819): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacatggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcacactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgancaaagcagactacgagaaacacaaagtctacgcctgcgaagtcacccatcnggnctgagctcgcccgtcacaaagagcttcaacngggganagtgttagaagcttggccgccatggcccaacttgtttattgcagcttataatgg

SEQ ID NO: 3329 - DNA, 475 bp, Artificial Sequence
  source: /note="Description of Artificial Sequence: Synthetic polynucleotide"
  modified_base (3)..(3): a, c, t, g, unknown or other
  modified_base (464)..(464): a, c, t, g, unknown or other
  modified_base (470)..(471): a, c, t, g, unknown or other
  modified_base (473)..(474): a, c, t, g, unknown or other
ttncccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccaccttggtccctccgccgaaagtgtgaggagtttgtagagcttgcatgcagtaataaaccccaacatcctcagcctccactctgctgattttcagtgtaaaatctgtgcctgatccactgccactgaacctgtcagggaccccggaggcccgattagaacccaaatagatcaggagctgtggagactgccctggcttctgcaggtaccaatccaaatagttgtatccattactatgcaggaggctctgactagacctgcaggagatggaggccggctctccaggggtgacgggcagggagantggagnntnng

SEQ ID NO: 3330 - DNA, 866 bp, Artificial Sequence
  source: /note="Description of Artificial Sequence: Synthetic polynucleotide"
  modified_base (685)..(685): a, c, t, g, unknown or other
  modified_base (834)..(835): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagttgcaggagtcgggcccaggactggtgaagccttcggagaccctgtccgtcacttgcactgtctctggtggctccatcagcagtagtaggtactactggggctggatccgccagcccccagggaaggggctggagtggattgggagtatctattatagtgggagcacctactacaacccgtccctcaagagtcgagtcaccatatccgtggacacgtccaagaaccagttctccctgaagctgagctctgtgaccgccgcagacacggctgtgtattactgtgcgagacatgcggcagcatactatgatagaagtggttattatttcatcgaatacttccagcactggggccagggcaccctggtcaccgtctcctcagcctccaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaannggacaagagagttgagcccaaatcttgtgac

SEQ ID NO: 3331 - DNA, 442 bp, Artificial Sequence
  source: /note="Description of Artificial Sequence: Synthetic polynucleotide"
  modified_base (441)..(441): a, c, t, g, unknown or other
gctgtgccccagaggtgctcttggaggagggtgccagggggaagaccgatgggcccttggtggaggctgaggagacggtgaccagggtgccctggccccagtgctggaagtattcgatgaaataataaccacttctatcatagtatgctgccgcatgtctcgcacagtaatacacagccgtgtctgcggcggtcacagagctcagcttcagggagaactggttcttggacgtgtccacggatatggtgactcgactcttgagggacgggttgtagtaggtgctcccactataatagatactcccaatccactccagccccttccctgggggctggcggatccagccccagtagtacctactactgctgatggagccaccagagacagtgcaagtgacggacagggtctccgaaggcttcaccagtcctgggcccgactccng

SEQ ID NO: 3332 - DNA, 859 bp, Artificial Sequence
  source: /note="Description of Artificial Sequence: Synthetic polynucleotide"
  modified_base (799)..(799): a, c, t, g, unknown or other
  modified_base (822)..(822): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagcgtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataataattaccggtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacnggggagagtgttagaagcttggncgccatggcccaacttgtttattgcagcttataatgg

SEQ ID NO: 3333 - DNA, 451 bp, Artificial Sequence
  source: /note="Description of Artificial Sequence: Synthetic polynucleotide"
  modified_base (5)..(6): a, c, t, g, unknown or other
  modified_base (9)..(9): a, c, t, g, unknown or other
ctggnnttncccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccagcttggtcccctggccaaaagtgtaccggtaattattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgacgctgtctcctacagatgcagacaggg

SEQ ID NO: 3334 - DNA, 879 bp, Artificial Sequence
  source: /note="Description of Artificial Sequence: Synthetic polynucleotide"
  modified_base (28)..(28): a, c, t, g, unknown or other
  modified_base (679)..(679): a, c, t, g, unknown or other
  modified_base (731)..(731): a, c, t, g, unknown or other
  modified_base (833)..(833): a, c, t, g, unknown or other
  modified_base (835)..(836): a, c, t, g, unknown or other
  modified_base (862)..(862): a, c, t, g, unknown or other
tacacatacgatttaggtgacactatanaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagcaagtggaatttattgtagtggtggagactgctactcatactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcagnactctactccctcagcagcgtggtgaccgtgccctccagcagcttgggcacccagacctacatctgcaacgtgaatcacaagcccagcaacaccaaggtggnannagagagttgagcccaaatcttgtganaaaactcacacatgccc

SEQ ID NO: 3335 - DNA, 444 bp, Artificial Sequence
  source: /note="Description of Artificial Sequence: Synthetic polynucleotide"
  modified_base (5)..(5): a, c, t, g, unknown or other
gctgngccccagaggtgctcttggaggagggtgccagggggaagaccgatgggcccttggtggaggctgaggagacggtgaccagggttccctggccccagtagtcaaagtagtatgagtagcagtctccaccactacaataaattccacttgctttcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgca

SEQ ID NO: 3336 - DNA, 879 bp, Artificial Sequence
  source: /note="Description of Artificial Sequence: Synthetic polynucleotide"
  modified_base (718)..(718): a, c, t, g, unknown or other
  modified_base (761)..(761): a, c, t, g, unknown or other
  modified_base (764)..(764): a, c, t, g, unknown or other
  modified_base (766)..(766): a, c, t, g, unknown or other
  modified_base (770)..(770): a, c, t, g, unknown or other
  modified_base (857)..(857): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcanactacgagaaacacaaagtctacgcctgcgaagtcacccatcnggncntganctcgcccgtcacaaagagcttcaacaggggagagtgttagaagcttggccgccatggcccaacttgtttattgcagcttataatggntacaaataaagcaatagcatca

SEQ ID NO: 3337 - DNA, 439 bp, Artificial Sequence
  source: /note="Description of Artificial Sequence: Synthetic polynucleotide"
  modified_base (438)..(438): a, c, t, g, unknown or other
cgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtcgaataactattatactgttggcagtaataagttgcaaaatcatcaggctgcaggctgctgatggtgagagtgaattctgtcccagatccactgccgctgaaccttgatgggaccccactttctaaactagacgccttatagatcaggagcttaggggctttccctggtttctgctgataccaggccaaccagctactaatactctgactggcccggcaagtgatggtgactctgtctcctacagatgcagacagggng

SEQ ID NO: 3338 - DNA, 880 bp, Artificial Sequence
  source: /note="Description of Artificial Sequence: Synthetic polynucleotide"
  modified_base (679)..(679): a, c, t, g, unknown or other
  modified_base (729)..(731): a, c, t, g, unknown or other
  modified_base (826)..(828): a, c, t, g, unknown or other
  modified_base (837)..(837): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagcaagtggaatatattgtagtggtggtaactgctactcatactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcaacaccannnggacaaganagttgagcccaaatcttgtgacaaaactcacacatgcccaccg

SEQ ID NO: 3339 - DNA, 435 bp, Artificial Sequence
  source: /note="Description of Artificial Sequence: Synthetic polynucleotide"
  modified_base (426)..(429): a, c, t, g, unknown or other
agaggtgctcttggaggagggtgccagggggaagaccgatgggcccttggtggaggctgaggagacggtgaccagggttccctggccccagtagtcaaagtagtatgagtagcagttaccaccactacaatatattccacttgctttcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccannnnctgcac

SEQ ID NO: 3340 - DNA, 879 bp, Artificial Sequence
  source: /note="Description of Artificial Sequence: Synthetic polynucleotide"
  modified_base (663)..(663): a, c, t, g, unknown or other
  modified_base (761)..(761): a, c, t, g, unknown or other
  modified_base (763)..(763): a, c, t, g, unknown or other
  modified_base (801)..(801): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccagtcagagtattagtagctggttggcctggtatcagcagaaaccagggaaagcccctaagctcctcatctataaggcgtctagtttagaaagtggggtcccatcaaggttcagcggcagtggatctgggacagaattcactctcaccatcagcagcctgcagcctgatgattttgcaacttattactgccaacagtataatagttattcgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgagcaaagcagactacgagaaacacaaagtctacgcctgcgaagtcacccatcngncctgagctcgcccgtcacaaagagcttcaacagggganagtgttagaagcttggccgccatggcccaacttgtttattgcagcttataatggttacaaataaagcaatagcatcac

SEQ ID NO: 3341 - DNA, 461 bp, Artificial Sequence
  source: /note="Description of Artificial Sequence: Synthetic polynucleotide"
  modified_base (452)..(455): a, c, t, g, unknown or other
ttacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtcgaataactattatactgttggcagtaataagttgcaaaatcatcaggctgcaggctgctgatggtgagagtgaattctgtcccagatccactgccgctgaaccttgatgggaccccactttctaaactagacgccttatagatgaggagcttaggggctttccctggtttctgctgataccaggccaaccagctactaatactctgactggcccggcaagtgatggtgactctgtctcctacagatgcagacagggagactggagnnnngggtca

SEQ ID NO: 3342 - DNA, 812 bp, Artificial Sequence
  source: /note="Description of Artificial Sequence: Synthetic polynucleotide"
  modified_base (56)..(56): a, c, t, g, unknown or other
  modified_base (58)..(58): a, c, t, g, unknown or other
  modified_base (667)..(667): a, c, t, g, unknown or other
tacacatacgatttaggtgacactatagaataacatccactttgcctttctctccncnggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagtagggtatgatagtagtggttattcgggctggtacttcgatctctggggccgtggcaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcacacc

SEQ ID NO: 3343 - DNA, 437 bp, Artificial Sequence
  source: /note="Description of Artificial Sequence: Synthetic polynucleotide"
  modified_base (12)..(12): a, c, t, g, unknown or other
cgctgtgccccngaggtgctcctggagcagggcgccagggggaagaccgatgggcccttggtggaagctgaggagacagtgaccagggtgccacggccccagagatcgaagtaccagcccgaataaccactactatcataccctactcttgcacagtaatacacagccgtgtccccggctctcaggctgttcatttgaagatacaaggagttcttggcattttctctggagatggtgaatcggcccttcacggagcctggatagtatgtgtcaccagcagtaccaatagctgagacccactccagaccttttcctgtagcttggcggacccagtgcatgtcgtagctactgaaggtgaatccagaggctgcacaggagagtctcagggaccccccaggctgtaccaagcctcccccagactccaccagcctgcacct

SEQ ID NO: 3344 - DNA, 881 bp, Artificial Sequence
  source: /note="Description of Artificial Sequence: Synthetic polynucleotide"
  modified_base (669)..(669): a, c, t, g, unknown or other
  modified_base (801)..(801): a, c, t, g, unknown or other
  modified_base (807)..(807): a, c, t, g, unknown or other
  modified_base (809)..(809): a, c, t, g, unknown or other
  modified_base (857)..(857): a, c, t, g, unknown or other
  modified_base (862)..(862): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccgggcaagtcagagcattagcagctatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgagcaaagcagactacgagaaacacaaagtctacgcctgcgaagtcacccatcaggcctgagctcgcccgtcacaaagagcttcaacngggganantgttagaagcttggccgccatggcccaacttgtttattgcagcttatnatggntacaaataaagcaatagca

SEQ ID NO: 3345 - DNA, 449 bp, Artificial Sequence
  source: /note="Description of Artificial Sequence: Synthetic polynucleotide"
tacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatctccaccttggtccctccgccgaaagtgagcggaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggaccttaggggctttccctggtttctgctgataccaatttaaatagctgctaatgctctgacttgcccggcaagtgatggtgactctgtctcctacagatgcagacagggag

SEQ ID NO: 3346 - DNA, 879 bp, Artificial Sequence
  source: /note="Description of Artificial Sequence: Synthetic polynucleotide"
  modified_base (676)..(676): a, c, t, g, unknown or other
  modified_base (727)..(727): a, c, t, g, unknown or other
  modified_base (825)..(825): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggcactagttggaatagtggcaccataggctatgcggactctgtgaagggccgattcaccatctccagagacaacgccaagaactccctgtatctgcaaatgaacagtctgagagctgaggacacggccttgtattactgtgcaaaaggcagggtggtgtatgctatagacccggactcggtctcgccgtttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccg

SEQ ID NO: 3347 - DNA, 452 bp, Artificial Sequence
  source: /note="Description of Artificial Sequence: Synthetic polynucleotide"
  modified_base (9)..(12): a, c, t, g, unknown or other
  modified_base (448)..(449): a, c, t, g, unknown or other
cgctgtgcnnnngaggtgctcttggaggagggtgccagggggaagaccgatgggcccttggtggaggctgaggagacggtgaccagggttccctggccccagtagtcaaacggcgagaccgagtccgggtctatagcatacaccaccctgccttttgcacagtaatacaaggccgtgtcctcagctctcagactgttcatttgcagatacagggagttcttggcgttgtctctggagatggtgaatcggcccttcacagagtccgcatagcctatggtgccactattccaactagtgcctgagacccactccaggcccttccctggagcttgccggacccagtgcatggcataatcatcaaaggtgaatccagaggctgcacaggagagtctcagggacctgccaggctgtaccaagcctcccccagactccaccagcctgcacctannatg

SEQ ID NO: 3348 - DNA, 881 bp, Artificial Sequence
  source: /note="Description of Artificial Sequence: Synthetic polynucleotide"
  modified_base (792)..(792): a, c, t, g, unknown or other
  modified_base (839)..(839): a, c, t, g, unknown or other
  modified_base (872)..(872): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtggcgttggtggttataactttgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgactatcactgcagctcatatacaagcaggagcactctgggggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtgganaagacagtggccctacagaatgttcatagaagcttggccgccatggnccaacttgtttattgcagcttataatggttacnaataaagca

SEQ ID NO: 3349 - DNA, 389 bp, Artificial Sequence
  source: /note="Description of Artificial Sequence: Synthetic polynucleotide"
  modified_base (2)..(2): a, c, t, g, unknown or other
  modified_base (8)..(8): a, c, t, g, unknown or other
  modified_base (374)..(376): a, c, t, g, unknown or other
  modified_base (378)..(379): a, c, t, g, unknown or other
anggggcnaccttgggctgacctaggacggtcagcttggtccctccgccgaatacccccagagtgctcctgcttgtatatgagctgcagtgatagtcagcctcgtcctcagcctggagcccagagatggtcagggaggccgtgttgccagacttggagccagagaagcgattagaaacccctgagggccgattactgacatcataaatcatgagtttgggggctttgcctgggtgttgttggtaccaggagacaaagttataaccaccaacgccactgctggttccagtgcaggagatggtgatcgactgtccaggagacccagacacggaggcaggctgagtcagcacagactgggaccaggaaccggttgcnnntnncctactagaa

SEQ ID NO: 3350 - DNA, 878 bp, Artificial Sequence
  source: /note="Description of Artificial Sequence: Synthetic polynucleotide"
  modified_base (724)..(724): a, c, t, g, unknown or other
  modified_base (820)..(820): a, c, t, g, unknown or other
  modified_base (830)..(830): a, c, t, g, unknown or other
  modified_base (834)..(834): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcgtgtgcagcctctggattcaccttcagtaactacgacattcactgggtccgccaagctacaggagaaggtctggagtgggtctcagcaattggtactggtggtgacacatactatccaggctccgtgaggggccgattcaccatctccagagaaaatgccaagaactccgtgtttcttcaaatgaacagcctgagagccggggacacggctgtgtattactgtgcaagaggtcggggacattgtagtagtatcagctgcttgcatagttggttcgactcctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnaaggtggacnaganagttgagcccaaatcttgtgacaaaactcacacatgcccaccgt

SEQ ID NO: 3351 - DNA, 380 bp, Artificial Sequence
  source: /note="Description of Artificial Sequence: Synthetic polynucleotide"
  modified_base (376)..(377): a, c, t, g, unknown or other
tgaggagacggtgaccagggttccctggccccaggagtcgaaccaactatgcaagcagctgatactactacaatgtccccgacctcttgcacagtaatacacagccgtgtccccggctctcaggctgttcatttgaagaaacacggagttcttggcattttctctggagatggtgaatcggcccctcacggagcctggatagtatgtgtcaccaccagtaccaattgctgagacccactccagaccttctcctgtagcttggcggacacagtgaatgtcgtagttactgaaggtgaatccagaggctgcacacgagagtctcagggaccccccaggctgtaccaagcctcccccagactccaccagctgcacctannatg

SEQ ID NO: 3352 - DNA, 872 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgacgcagccgccctcagtgtctggggccccagggcagagggtcaccatctcctgcactgggagcagctccaacatcggggcaggttctgatgtacactggtaccagaaacttccaggaacagcccccaaagtcctcatctatggttacagcaatcggccctcaggggtccctgaccgattctctggctccaagtctggcacctcagcctccctggccatcacagggctccaggctgaggatgaggctgattattactgccagtcctatgacaccagcctgagggtggtattcggcggagggaccaagctgaccgtcctgggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaa

SEQ ID NO: 3353 - DNA, 357 bp, Artificial Sequence
  source: /note="Description of Artificial Sequence: Synthetic polynucleotide"
  modified_base (340)..(340): a, c, t, g, unknown or other
  modified_base (344)..(344): a, c, t, g, unknown or other
  modified_base (347)..(347): a, c, t, g, unknown or other
  modified_base (352)..(352): a, c, t, g, unknown or other
  modified_base (355)..(356): a, c, t, g, unknown or other
tgggctgacccaggacggtcagcttggtccctccgccgaataccaccctcaggctggtgtcataggactggcagtaataatcagcctcatcctcagcctggagccctgtgatggccagggaggctgaggtgccagacttggagccagagaatcggtcagggacccctgagggccgattgctgtaaccatagatgaggactttgggggctgttcctggaagtttctggtaccagtgtacatcagaacctgccccgatgttggagctgctcccagtgcaggagatggtgaccctctgccctggggccccagacactgagggcggctgagtcagcacagactnggcnccnagaancgnnt

SEQ ID NO: 3354 - DNA, 881 bp, Artificial Sequence
  source: /note="Description of Artificial Sequence: Synthetic polynucleotide"
  modified_base (822)..(822): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcgtgtgcagcctctggattcaccttcagtaactacgacatgcactgggtccgccaagttacaggagaaggtctggagtgggtctcagcaattggtactgctggtgacacatactatccaggctccgtgaagggccgattcaccatctccagagaaaatgccaagaactccgtgtttcttcaaatgaacagcctgagagccggggacacggctgtgtattactgtgcaagaggtcggggacattgtagtagtatcagctgcttgcatagctggttcgactcctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgccc

SEQ ID NO: 3355 - DNA, 389 bp, Artificial Sequence
  source: /note="Description of Artificial Sequence: Synthetic polynucleotide"
  modified_base (374)..(376): a, c, t, g, unknown or other
  modified_base (383)..(384): a, c, t, g, unknown or other
ctgaggagacggtgaccagggttccctggccccaggagtcgaaccagctatgcaagcagctgatactactacaatgtccccgacctcttgcacagtaatacacagccgtgtccccggctctcaggctgttcatttgaagaaacacggagttcttggcattttctctggagatggtgaatcggcccttcacggagcctggatagtatgtgtcaccagcagtaccaattgctgagacccactccagaccttctcctgtaacttggcggacccagtgcatgtcgtagttactgaaggtgaatccagaggctgcacacgagagtctcagggaccccccaggctgtaccaagcctcccccagactccaccagctgcacnnnacactgnnacacc

SEQ ID NO: 3356 - DNA, 880 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgacgcagccgccctcagtgtctggggccccagggcagagggtcaccatctcctgcactgggagcagctccaacatcggggcaggttctgatgtacactggtaccagaaacttccaggaatagcccccaaagtcctcatctatggctacagcaatcggccctcaggggtccctgaccgattctctggctccaagtctggcacctcagcctccctggccatcacagggctccaggctgaggatgaggctgattattactgccagtcctatgacaccagcctgagggtggtattcggcggagggaccaagctgaccgtcctgggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaa

SEQ ID NO: 3357 - DNA, 357 bp, Artificial Sequence
  source: /note="Description of Artificial Sequence: Synthetic polynucleotide"
  modified_base (347)..(347): a, c, t, g, unknown or other
  modified_base (356)..(357): a, c, t, g, unknown or other
ttgggctgacccaggacggtcagcttggtccctccgccgaataccaccctcaggctggtgtcataggactggcagtaataatcagcctcatcctcagcctggagccctgtgatggccagggaggctgaggtgccagacttggagccagagaatcggtcagggacccctgagggccgattgctgtagccatagatgaggactttgggggctattcctggaagtttctggtaccagtgtacatcagaacctgccccgatgttggagctgctcccagtgcaggagatggtgaccctctgccctggggccccagacactgagggcggctgagtcagcacagactgggaccnggaaccggnn

SEQ ID NO: 3358 - DNA, 881 bp, Artificial Sequence
  source: /note="Description of Artificial Sequence: Synthetic polynucleotide"
  modified_base (822)..(822): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcgtgtgcagcctctggattcaccttcagtaactacgacatgcactgggtccgccaagctacaggagaaggtctggagtgggtctcagcaattggtactgctggtgacacatactatccaggctccgtgaagggccgattcaccatctccagagaaaatgccaagaactccgtgtttcttcaaatgaacagcctgagagccggggacacggctgtgtattactgtgcaagaggtcggggacattgtagtagtatcagctgcttgcatagctggttcgactcctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgccc

SEQ ID NO: 3359 - DNA, 371 bp, Artificial Sequence
  source: /note="Description of Artificial Sequence: Synthetic polynucleotide"
  modified_base (14)..(14): a, c, t, g, unknown or other
  modified_base (357)..(357): a, c, t, g, unknown or other
  modified_base (367)..(368): a, c, t, g, unknown or other
ggtgaccagggttncctggccccaggagtcgaaccagctatgcaagcagctgatactactacaatgtccccgacctcttgcacagtaatacacagccgtgtccccggctctcaggctgttcatttgaagaaacacggagttcttggcattttctctggagatggtgaatcggcccttcacggagcctggatagtatgtgtcaccagcagtaccaattgctgagacccactccagaccttctcctgtagcttggcggacccagtgcatgtcgtagttactgaaggtgaatccagaggctgcacacgagagtctcagggaccccccaggctgtaccaagcctcccccagactccaccanctgcacctannatg

SEQ ID NO: 3360 - DNA, 881 bp, Artificial Sequence
  source: /note="Description of Artificial Sequence: Synthetic polynucleotide"
  modified_base (729)..(729): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgacgcagccgccctcagtgtctggggccccagggcagagggtcaccatctcctgcactgggagtagctccaacatcggggcaggttctgatgtacactggtaccagaaacttccaggaacagcccccaaagtcctcatctatggttacagcaatcggccctcgggggtccctgaccgattctctggctccaagtctggcacctcagcctccctggccatcacagggctccaggctgaggatgaggctgattattactgccagtcctatgacaccagcctgagggtggtattcggcggagggaccaagctgaccgtcctgggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgancagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaat

SEQ ID NO: 3361 - DNA, 358 bp, Artificial Sequence
  source: /note="Description of Artificial Sequence: Synthetic polynucleotide"
  modified_base (345)..(345): a, c, t, g, unknown or other
  modified_base (357)..(358): a, c, t, g, unknown or other
cttgggctgacccaggacggtcagcttggtccctccgccgaataccaccctcaggctggtgtcataggactggcagtaataatcagcctcatcctcagcctggagccctgtgatggccagggaggctgaggtgccagacttggagccagagaatcggtcagggacccccgagggccgattgctgtaaccatagatgaggactttgggggctgttcctggaagtttctggtaccagtgtacatcagaacctgccccgatgttggagctactcccagtgcaggagatggtgaccctctgccctggggccccagacactgagggcggctgagtcagcacagactgggnccaggaaccggnn

SEQ ID NO: 3362 - DNA, 880 bp, Artificial Sequence
  source: /note="Description of Artificial Sequence: Synthetic polynucleotide"
  modified_base (673)..(673): a, c, t, g, unknown or other
  modified_base (724)..(724): a, c, t, g, unknown or other
  modified_base (832)..(832): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcgtgtgcagcctctggattcaccttcagtaactacgacatacactgggtccgccaggctacaggagaaggtctggagtgggtctcagcaattggtactgctggtgacacatactatccaggctccgtgaagggccgattcaccatctccagagaaaatgccaagaactccgtgtttcttcaaatgaacagcctgagagccggggacacggcggtgtattactgtgcaagaggtcggggacattgtagtagtatcagctgcttgcatagctggttcgactcctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaaggtggacaganagttgagcccaaatcttgtgacaaaactcacacatgcccaccgtgccc

SEQ ID NO: 3363 - DNA, 381 bp, Artificial Sequence
  source: /note="Description of Artificial Sequence: Synthetic polynucleotide"
  modified_base (10)..(10): a, c, t, g, unknown or other
  modified_base (377)..(378): a, c, t, g, unknown or other
ctgaggaganggtgaccagggttccctggccccaggagtcgaaccagctatgcaagcagctgatactactacaatgtccccgacctcttgcacagtaatacaccgccgtgtccccggctctcaggctgttcatttgaagaaacacggagttcttggcattttctctggagatggtgaatcggcccttcacggagcctggatagtatgtgtcaccagcagtaccaattgctgagacccactccagaccttctcctgtagcctggcggacccagtgtatgtcgtagttactgaaggtgaatccagaggctgcacacgagagtctcagggaccccccaggctgtaccaagcctcccccagactccaccagctgcacctannatg

SEQ ID NO: 3364 - DNA, 881 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgacgcagccgccctcagtgtctggggccccagggcagagggtcaccatctcctgcactgggagcagctccaacatcggggcaggttctgatgtacactggtaccagaaacttccaggaacagcccccaaagtcctcatctatggttacaacaatcggccctcaggggtccctgaccgattctctggctccaagtctggcacctcagcctccctggccatcacagggctccaggctgaggatgaggctgattattactgccagtcctatgacaccagtttgagggtggtattcggcggagggaccaagctgaccgtcctgggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaat

SEQ ID NO: 3365 - DNA, 364 bp, Artificial Sequence
  source: /note="Description of Artificial Sequence: Synthetic polynucleotide"
  modified_base (344)..(347): a, c, t, g, unknown or other
  modified_base (356)..(356): a, c, t, g, unknown or other
  modified_base (359)..(362): a, c, t, g, unknown or other
ttgggctgacccaggacggtcagcttggtccctccgccgaataccaccctcaaactggtgtcataggactggcagtaataatcagcctcatcctcagcctggagccctgtgatggccagggaggctgaggtgccagacttggagccagagaatcggtcagggacccctgagggccgattgttgtaaccatagatgaggactttgggggctgttcctggaagtttctggtaccagtgtacatcagaacctgccccgatgttggagctgctcccagtgcaggagatggtgaccctctgccctggggccccagacactgagggcggctgagtcagcacagactgggnnnnggaaccggntgnnnntg

SEQ ID NO: 3366 - DNA, 868 bp, Artificial Sequence
  source: /note="Description of Artificial Sequence: Synthetic polynucleotide"
  modified_base (753)..(754): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagaggggtagcagtggactggtacttcgatctctggggccgtggcaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttnncacccagacctacatctgcaacgtgaatcacaagcccagcaacaccaaggtggacaagagagttgagcccaaatcttgtgacaaaactcacacatgcccaccgtgcccagcacc

SEQ ID NO: 3367 - DNA, 424 bp, Artificial Sequence
  source: /note="Description of Artificial Sequence: Synthetic polynucleotide"
  modified_base (2)..(3): a, c, t, g, unknown or other
gnngctgtgccccagaggtgctcttggaggagggtgccagggggaagaccgatgggcccttggtggaggctgaggagacagtgaccagggtgccacggccccagagatcgaagtaccagtccactgctacccctctcgcacagtaatacatggcggtgtccgaggccttcaggctgctccactgcaggtaggcggtgctgatggacttgtcggctgagatggtgacctggccttggaaggacgggctgtatctggtatcagagtcaccaggatagatgatccccatccactccaggcctttcccgggcatctggcgcacccagccgatccagtagctggtaaagctgtatccagaacccttacaggagatcttcagagactccccgggctttttcacctctgctccagactgcaccagctgcac

SEQ ID NO: 3368 - DNA, 869 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgccctttatgtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataat

SEQ ID NO: 3369 - DNA, 365 bp, Artificial Sequence
  source: /note="Description of Artificial Sequence: Synthetic polynucleotide"
  modified_base (363)..(363): a, c, t, g, unknown or other
cttgggctgacctaggacggtgaccttggtcccagttccgaagacataaagggcactcaggctgctgtcataggactggcagtaataatcagcctcatcctcagcctggagcccagtgatggccagggaggctgaggtgccagacttggagccagagaatcggtcagggacccctgagggccgattgctgttaccatagatgaggagtttgggggctgttcctggaagctgctggtaccagtgtacatcataacctgccccgatgttggagctgctcccagtgcaggagatggtgaccctctgccctggggccccagacactgagggcggctgagtcagcacagactgggaccaggaaccggntg

SEQ ID NO: 3370 - DNA, 879 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctgcaggagtcgggcccaggactagtgaagccttcggagaccctgtccctcacctgcactgtctctggtgcctccatcaatagttactactggacctggatccggcagcccccagggaagggactggaatggattggatatatccatgacagtgggaacaccaactacaaccccgccctcaggagtcgagtcaccatatcactagacacgtcgaagaatcagttctccctgaaggtgaggtctgtgaccgctgcggacacggccgtctattactgtgcgagagaggtagtagtacaatctgcaaaagattggtctcactactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgccca

SEQ ID NO: 3371 - DNA, 438 bp, Artificial Sequence
  source: /note="Description of Artificial Sequence: Synthetic polynucleotide"
  modified_base (425)..(425): a, c, t, g, unknown or other
agaggtgctcttggaggagggtgccagggggaagaccgatgggcccttggtggaggctgaggagacgctgaccgtggtccctttgccccagacgtccatgtagtagtagtagtgagaccaatcttttgcagattgtactactacctctctcgcacagtaatagacggccgtgtccgcagcggtcacagacctcaccttcagggagaactgattcttcgacgtgtctagtgatatggtgactcgactcctgagggcggggttgtagttggtgttcccactgtcatggatatatccaatccattccagtcccttccctgggggctgccggatccaggtccagtagtaactattgatggaggcaccagagacagtgcaggtgagggacagggtctccgaaggcttcactagtcctgggcccgactccngcagcctgcacct

SEQ ID NO: 3372 - DNA, 871 bp, Artificial Sequence
  source: /note="Description of Artificial Sequence: Synthetic polynucleotide"
  modified_base (765)..(765): a, c, t, g, unknown or other
  modified_base (810)..(813): a, c, t, g, unknown or other
  modified_base (817)..(817): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacacagtctccagccaccctgtctttgtctccaggggaaagagcctccctctcctgcagggccagtcagagtgttggtacctacttagcctggtaccaacagaaagttggccagcctcccaggctcctcatctatgatgcgtccaacagggccactggcatcccagccaggttcagtggcagtgggtctgggacagacttcactctcaccatcagcagcctagaccctgaagattttgcagtttattactgtcagcagcgtagcagctggttcgtcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcanggcctgagctcgcccgtcacaaagagcttcaacaggggagagtgnnnnaaancttggccgccatggcccaacttgtttattgcagcttataatggttacaaataaa

SEQ ID NO: 3373 - DNA, 443 bp, Artificial Sequence
  source: /note="Description of Artificial Sequence: Synthetic polynucleotide"
taccgattggagggcgttatccaccttccactgtactttggcctctctgggatagaagttattcagcaggcacacaacagaggcagttccagatttcaactgctcatcagatggcgggaagatgaagacagatggtgcagccacagttcgtttaatctccagtcgagtcccttggccgaaggtgacgaaccagctgctacgctgctgacagtaataaactgcaaaatcttcagggtctaggctgctgatggtgagagtgaagtctgtcccagacccactgccactgaacctggctgggatgccagtggccctgttggacgcatcatagatgaggagcctgggaggctggccaactttctgttggtaccaggctaagtaggtaccaacactctgactggccctgcaggagagggaggctctttcccctggagacaaagacaggg

SEQ ID NO: 3374 - DNA, 878 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtcccgcacctgcgctgtctttggtgggtccttcactaattactactggagttggatccgccagtccccagggaaggggctggagtggattggggaaatcaatgatagtggaatcaccaactacaacccgtccctcaagagtcgagtcaccatctcagtagacacgtccaagaaccagttctccctgagcctgaggtctgtgaccgccgcggacacggctgtgtattactgtgccagaaggaggtccttctctcgtccttcgtctatcgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttggggcacccagacctacatctgcaacgtgaatcacaagcccagcaacaccaaggtggacaagagagttgagcccaaatcttgtgacaaaactcacacatgcccaccgtgcccagcacctgaac

SEQ ID NO: 3375 - DNA, 423 bp, Artificial Sequence
  source: /note="Description of Artificial Sequence: Synthetic polynucleotide"
  modified_base (9)..(10): a, c, t, g, unknown or other
gctgtgccnngaggtgctcttggaggagggtgccagggggaagaccgatgggcccttggtggaggctgaggagacggtgaccagggttccctggccccagtagtcgatagacgaaggacgagagaaggacctccttctggcacagtaatacacagccgtgtccgcggcggtcacagacctcaggctcagggagaactggttcttggacgtgtctactgagatggtgactcgactcttgagggacgggttgtagttggtgattccactatcattgatttccccaatccactccagccccttccctggggactggcggatccaactccagtagtaattagtgaaggacccaccaaagacagcgcaggtgcgggacagggtctccgaaggcttcaacagtcctgcgccccactgctgtagctgcac

SEQ ID NO: 3376 - DNA, 858 bp, Artificial Sequence
  source: /note="Description of Artificial Sequence: Synthetic polynucleotide"
  modified_base (812)..(812): a, c, t, g, unknown or other
  modified_base (816)..(816): a, c, t, g, unknown or other
  modified_base (818)..(818): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacatggggatattgtgatgactcagtctccactctccctgcccgtcacccctggagagccggcctccatctcctgcaggtctagtcagagcctcctgcatagaaatggatacaactatttggattggtacctgcagaagccagggcagtctccacagctcctgatctatttgggttccaatcgggcctccggggtccctgacaggttcaggggcagtggatcaggcacagatttcacactgaaaatcagcagagtggaggctgaggatgttggggtttattactgcatgcaagctctacaaactctcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacangggnanagtgttagaagcttggccgccatggcccaacttgtttatt

SEQ ID NO: 3377 - DNA, 459 bp, Artificial Sequence
  source: /note="Description of Artificial Sequence: Synthetic polynucleotide"
tacccgattggagggcgttatccaccttccactgtactttggcctctctgggatagaagttattcagcaggcacacaacagaggcagttccagatttcaactgctcatcagatggcgggaagatgaagacagatggtgcagccacagttcgtttaatctccagtcgtgtcccttggccgaaggtgagagtttgtagagcttgcatgcagtaataaaccccaacatcctcagcctccactctgctgattttcagtgtgaaatctgtgcctgatccactgcccctgaacctgtcagggaccccggaggcccgattggaacccaaatagatcaggagctgtggagactgccctggcttctgcaggtaccaatccaaatagttgtatccatttctatgcaggaggctctgactagacctgcaggagatggaggccggctctccaggggtgacggggcagggag

SEQ ID NO: 3378 - DNA, 875 bp, Artificial Sequence
  source: /note="Description of Artificial Sequence: Synthetic polynucleotide"
  modified_base (814)..(814): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggccccatattgtagtggtggtagctgcaatgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaaggtggacaagagagttgagcccaaatcttgtgacaaaactcacacatgcccaccgtgcc

SEQ ID NO: 3379 - DNA, 425 bp, Artificial Sequence
  source: /note="Description of Artificial Sequence: Synthetic polynucleotide"
  modified_base (12)..(12): a, c, t, g, unknown or other
  modified_base (424)..(424): a, c, t, g, unknown or other
cgctgtgccccngaggtgctcctggagcagggcgccagggggaagaccgatgggcccttggtggaagctgaagagacggtgaccattgtcccttggccccagatatcaaaagcatcattgcagctaccaccactacaatatggggccgcacagtaatacacggccgtgtcctcggatctcaggctgctcagctccatgtaggctgtgcttgtggacatgtccctggtaatggtgactctttcctggaacttctgtgcgtagtttgtgttaccactgccaacgacgatccatcctatccactcaaggcgttgtccacgagcctgtcgcacccactgcatagcagagctagtaaaggtgaatccagaagccttgcaggagaccttcactgaggtcccaggcttcttcacctcaggcccagactgcnc

SEQ ID NO: 3380 - DNA, 869 bp, Artificial Sequence
  source: /note="Description of Artificial Sequence: Synthetic polynucleotide"
  modified_base (768)..(768): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcanggcctgagctcgcccgtcacaaagagcttcaacaggggagagtgttagaagcttggccgccatggcccaacttgtttattgcagcttataatggttacaaa

SEQ ID NO: 3381 - DNA, 459 bp, Artificial Sequence
  source: /note="Description of Artificial Sequence: Synthetic polynucleotide"
  modified_base (51)..(52): a, c, t, g, unknown or other
  modified_base (54)..(54): a, c, t, g, unknown or other
  modified_base (58)..(59): a, c, t, g, unknown or other
  modified_base (443)..(443): a, c, t, g, unknown or other
  modified_base (446)..(446): a, c, t, g, unknown or other
  modified_base (449)..(449): a, c, t, g, unknown or other
  modified_base (453)..(453): a, c, t, g, unknown or other
attggagggcgttatccaccttccactgtactttggcctctctgggatagnncntaanncagcaggcacacaacagaggcagttccagatttcaactgctcatcagatggcgggaagatgaagacagatggtgcagccacagttcgtttgatttccaccttggtcccttggccgaacgtccacggtgagctaccatactgctgacagtaatacactgcaaaatcttcaggctccagtctgctgatggtgagagtgaagtctgtcccagacccactgccactgaacctgtctgggatgccagtggccctgctggatgcaccatagatgaggagcctgggagcctggccaggtttctgctggtaccaggctaagtagctgctgctaacactctgactggccctgcaggagagggtggctctttcccctggagacaaagacagggngantgnagantgggtc

SEQ ID NO: 3382 - DNA, 879 bp, Artificial Sequence
  source: /note="Description of Artificial Sequence: Synthetic polynucleotide"
  modified_base (817)..(817): a, c, t, g, unknown or other
  modified_base (819)..(819): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcaatagaattgccatgtactgggtccgccaggctccaggcaaggggctggaatgggtggcagttatatcatttgatggaagttatgaatactatgcagagtccgtgaagggccggttcgccatctccagagacaattccaagaacacgctgtatctacagatgaacagcctgagagctgaggacacggctgtctattactgtgcgaaaagtccgatgggttattgcactaatggtgtatgctatcctgactcctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgccca

SEQ ID NO: 3383 - DNA, 437 bp, Artificial Sequence
  source: /note="Description of Artificial Sequence: Synthetic polynucleotide"
  modified_base (14)..(14): a, c, t, g, unknown or other
  modified_base (430)..(431): a, c, t, g, unknown or other
ctgtgctctcggangtgctcctggagcagggcgccagggggaagaccgatgggcccttggtggaggctgaggagacggtgaccagggttccctggccccaggagtcaggatagcatacaccattagtgcaataacccatcggacttttcgcacagtaatagacagccgtgtcctcagctctcaggctgttcatctgtagatacagcgtgttcttggaattgtctctggagatggcgaaccggcccttcacggactctgcatagtattcataacttccatcaaatgatataactgccacccattccagccccttgcctggagcctggcggacccagtacatggcaattctattgaaggtgaatccagaggctgcacaggagagtctcagggacctcccaggctggaccacgcctcccccagactccaccannctgcac

SEQ ID NO: 3384 - DNA, 869 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcttgggccaattttatgctgactcagccccactctgtgtcggagtctccggggaagacggttaccatctcctgcaccggcagcagtggcagcattgccagcaactatgtgcagtggtaccagcagcgcccgggcagtgcccccaccactgtgatctatgaagatacccaaagaccctctggggtccctgatcggttctctggctccatcgacagctcctccaattctgcctccctcaccatctctggactgaagactgaggacgaggctgactactactgtcagtcttatgatatcaacagtcgttgggtgttcggcggagggaccaagctgaccgtcctaagccagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttgggccgccatggcccaacttgtttattgcagcttataatgg

SEQ ID NO: 3385 - DNA, 360 bp, Artificial Sequence
  source: /note="Description of Artificial Sequence: Synthetic polynucleotide"
  modified_base (358)..(358): a, c, t, g, unknown or other
tgggctggcttaggacggtcagcttggtccctccgccgaacacccaacgactgttgatatcataagactgacagtagtagtcagcctcgtcctcagtcttcagtccagagatggtgagggaggcagaattggaggagctgtcgatggagccagagaaccgatcagggaccccagagggtctttgggtatcttcatagatcacagtggtgggggcactgcccgggcgctgctggtaccactgcacatagttgctggcaatgctgccactgctgccggtgcaggagatggtaaccgtcttccccggagactccgacacagagtggggctgagtcagcacagactgggaccaggaaccggntg

SEQ ID NO: 3386 - DNA, 880 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagctggttttggagtggttattacctatggttcaggaacggatcccctttttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccac

SEQ ID NO: 3387 - DNA, 452 bp, Artificial Sequence
  source: /note="Description of Artificial Sequence: Synthetic polynucleotide"
  modified_base (8)..(12): a, c, t, g, unknown or other
cgctgtgnnnnngaggtgctcttggaggagggtgccagggggaagaccgatgggcccttggtggaggctgaggagacggtgaccagggttccctggccccagtagtcaaaaaggggatccgttcctgaaccataggtaataaccactccaaaaccagctctcgcacagtaatacacagccgtgtccgcggcggtcacagagctcagcttcagggagaactggttcttggacgtgtctactgatatggtgactcgactcttgagggacgggttgtagttggtgcttccactatgattgatttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctggga

SEQ ID NO: 3388 - DNA, 882 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccgccctcagtgtctggggccccagggcagagggtcaccatctcctgcactgggagcaactccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcgagggtgtttggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaa

SEQ ID NO: 3389 - DNA, 364 bp, Artificial Sequence
  source: /note="Description of Artificial Sequence: Synthetic polynucleotide"
  modified_base (362)..(362): a, c, t, g, unknown or other
ttgggctgacctaggacggtcagcttggtccctccgccaaacaccctcgaaccactcaggctgctgtcataggactggcagtaataatcagcctcatcctcagcctggagcccagtgatggccagggaggctgaggtgccagacttggagccagagaatcggtcagggacccctgagggccgattgctgttaccatagatgaggagtttgggggctgttcctggaagctgctggtaccagtgtacatcataacctgccccgatgttggagttgctcccagtgcaggagatggtgaccctctgccctggggccccagacactgagggcggctgagtcagcacagactgggaccaggaaccggntg

SEQ ID NO: 3390 - DNA, 875 bp, Artificial Sequence
  source: /note="Description of Artificial Sequence: Synthetic polynucleotide"
  modified_base (739)..(739): a, c, t, g, unknown or other
  modified_base (835)..(835): a, c, t, g, unknown or other
  modified_base (837)..(837): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatccccattgtagtagtaccagctgccccattttttactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnangtggacaagagagttgagcccaaatcttgtgacaaaac

SEQ ID NO: 3391 - DNA, 455 bp, Artificial Sequence
  source: /note="Description of Artificial Sequence: Synthetic polynucleotide"
  modified_base (8)..(12): a, c, t, g, unknown or other
  modified_base (445)..(448): a, c, t, g, unknown or other
cgctgtgnnnnngaggtgctcttggaggagggtgccagggggaagaccgatgggcccttggtggaggctgaggagacggtgaccgtggtccctttgccccagacgtccatgtagtagtagtaaaaaatggggcagctggtactactacaatggggatctgtggtacagtaatacacggctgtgtcctcggttttcaggctgttcatttgcagatacagcgtgttttttgaatcatctcttgagatggtgaatctgcctttcacgggtgcagcgtagtctgttgtcccaccatcagttttgcttttaatacggccaacccactccagccccttccctggagcctggcggacccagctcatccaggcgttactgaaagtgaatccagaggctgcacaggagagtctaagggaccccccaggctttaccaagcctcccccagactccnnnnctgcacc

SEQ ID NO: 3392 - DNA, 871 bp, Artificial Sequence
  source: /note="Description of Artificial Sequence: Synthetic polynucleotide"
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcagggggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaag

SEQ ID NO: 3393 - DNA, 352 bp, Artificial Sequence
  source: /note="Description of Artificial Sequence: Synthetic polynucleotide"
ttgggctgacctaggacggtcagcttggtccctccgccgaataccccctgatcactactactatcccacacctgacagtaatagtcggcctcatccccggcttcgaccctgctgatggtcagggtggccgtgttcccagagttggagccagagaatcgctcagggatccctgagggccggtcgctatcatcatagacgaccagcacaggggcctggcctggcttctgctggtaccagtgcacacttttacttccaatgttgtttcccccacaggtaatcctggccgtctgtcctggggccactgacaccgagggtggctgagtcagcacatactgggaccaggaaccggttg

SEQ ID NO: 3394 - DNA, 872 bp, Artificial Sequence
  source: /note="Description of Artificial Sequence: Synthetic polynucleotide"
  modified_base (663)..(663): a, c, t, g, unknown or other
  modified_base (714)..(714): a, c, t, g, unknown or other
  modified_base (810)..(810): a, c, t, g, unknown or other
  modified_base (812)..(812): a, c, t, g, unknown or other
  modified_base (823)..(823): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaagtcaatcatagtggaagcaccaactacaacccgtccctcaagagtcgagtcaccatatcagtagacacgtccaagaaccagttcttcctgaagctgagctctgtgaccgccgcggacacggctgtgtattactgtgcgagacactggatgccgagggactactactactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcngcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnangtggacaaganagttgagcccaaatcttgtgacaaactcacacatgcccaccgtgcccag

SEQ ID NO: 3395 - DNA, 440 bp, Artificial Sequence
  source: /note="Description of Artificial Sequence: Synthetic polynucleotide"
  modified_base (2)..(2): a, c, t, g, unknown or other
  modified_base (10)..(15): a, c, t, g, unknown or other
  modified_base (436)..(438): a, c, t, g, unknown or other
gncgctgtgnnnnnnaggtgctcttggaggagggtgccagggggaagaccgatgggcccttggtggaggctgaggagacggtgaccgtggtcccttggccccagacgtccataccgtagtagtagtagtccctcggcatccagtgtctcgcacagtaatacacagccgtgtccgcggcggtcacagagctcagcttcaggaagaactggttcttggacgtgtctactgatatggtgactcgactcttgagggacgggttgtagttggtgcttccactatgattgacttccccaatccactccagccccttccctgggggctggcggatccagctccagtagtaaccactgaaggacccaccatagacagcgcaggtgagggacagggtctccgaaggcttcaacagtcctgcgccccactgctgtagctgcacctnnnaa

SEQ ID NO: 3396 - DNA, 882 bp, Artificial Sequence
  source: /note="Description of Artificial Sequence: Synthetic polynucleotide"
  modified_base (821)..(821): a, c, t, g, unknown or other
tacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggncgccatggcccaacttgtttattgcagcttataatggttacaaataaagcaatagcatcac

SEQ ID NO: 3397 - DNA, 450 bp, Artificial Sequence
  source: /note="Description of Artificial Sequence: Synthetic polynucleotide"
  modified_base (3)..(3): a, c, t, g, unknown or other
  modified_base (6)..(6): a, c, t, g, unknown or other
ganttncccgattggagggcgttatccaccttccactgtactttggcctctctgggatagaagttattcagcaggcacacaacagaggcagttccagatttcaactgctcatcagatggcgggaagatgaagacagatggtgcagccacagttcgtttgatttccaccttggtcccttggccgaacgtccgaggggtactgtaactctgttgacagtagtaagttgcaaaatcttcaggttgcagactgctgatggtgagagtgaaatctgtcccagatccactgccactgaaccttgatgggaccccactttgcaaactggatgcagcatagatcaggagcttaggggctttccctggtttctgctgataccaatttaaatagctgctaatgctctgacttgcccggcaagtgatggtgactctgtctcctacagatgcagacagggag

SEQ ID NO: 3398 - DNA, 1031 bp, Artificial Sequence
  source: /note="Description of Artificial Sequence: Synthetic polynucleotide"
  modified_base (1)..(13): a, c, t, g, unknown or other
  modified_base (815)..(815): a, c, t, g, unknown or other
  modified_base (817)..(818): a, c, t, g, unknown or other
  modified_base (929)..(929): a, c, t, g, unknown or other
  modified_base (951)..(951): a, c, t, g, unknown or other
  modified_base (958)..(958): a, c, t, g, unknown or other
  modified_base (974)..(975): a, c, t, g, unknown or other
  modified_base (980)..(981): a, c, t, g, unknown or other
  modified_base (986)..(986): a, c, t, g, unknown or other
  modified_base (996)..(996): a, c, t, g, unknown or other
  modified_base (1018)..(1018): a, c, t, g, unknown or other
  modified_base (1021)..(1023): a, c, t, g, unknown or other
  modified_base (1025)..(1028): a, c, t, g, unknown or other
  modified_base (1030)..(1031): a, c, t, g, unknown or other
nnnnnnnnnnnnngtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacacagactccgtgaagggccgattcaccatctccagagacaattccaagaacactctgtatcttcaaatgaacagcctgagagccgaggacacggccgtgtattactgtgtgcgggactacggtgacttctactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnanntggacaagagagttgagcccaaatcttgtgacaaaactcacacatgcccaccgtgcccagcacctgaactcctggggggaccgtcagtcttcctcttccccccaaaacccnaggacaccctcatgatctcccngaccccngagtcacatgcgtggnngtggnngtganccacgaagancctgaggtcaagttcaactggnacnnngnnnngnn

SEQ ID NO: 3399 - DNA, 352 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacacagactccgtgaagggccgattcaccatctccagagacaattccaagaacactctgtatcttcaaatgaacagcctgagagccgaggacacggccgtgtattactgtgtgcgggactacggtgacttctactttgactactggggccagggaaccctggtcaccgtctcctcag

SEQ ID NO: 3400 - DNA, 1060 bp, Artificial Sequence
  source: /note="Description of Artificial Sequence: Synthetic polynucleotide"
  modified_base (1)..(7): a, c, t, g, unknown or other
  modified_base (9)..(10): a, c, t, g, unknown or other
  modified_base (18)..(18): a, c, t, g, unknown or other
  modified_base (785)..(785): a, c, t, g, unknown or other
  modified_base (788)..(788): a, c, t, g, unknown or other
  modified_base (790)..(790): a, c, t, g, unknown or other
  modified_base (943)..(943): a, c, t, g, unknown or other
  modified_base (947)..(948): a, c, t, g, unknown or other
  modified_base (952)..(952): a, c, t, g, unknown or other
  modified_base (967)..(967): a, c, t, g, unknown or other
  modified_base (972)..(972): a, c, t, g, unknown or other
  modified_base (974)..(975): a, c, t, g, unknown or other
  modified_base (985)..(985): a, c, t, g, unknown or other
  modified_base (992)..(992): a, c, t, g, unknown or other
  modified_base (994)..(996): a, c, t, g, unknown or other
  modified_base (1004)..(1004): a, c, t, g, unknown or other
  modified_base (1006)..(1006): a, c, t, g, unknown or other
  modified_base (1014)..(1016): a, c, t, g, unknown or other
  modified_base (1019)..(1019): a, c, t, g, unknown or other
  modified_base (1026)..(1027): a, c, t, g, unknown or other
  modified_base (1031)..(1034): a, c, t, g, unknown or other
  modified_base (1047)..(1048): a, c, t, g, unknown or other
  modified_base (1050)..(1052): a, c, t, g, unknown or other
  modified_base (1054)..(1060): a, c, t, g, unknown or other
nnnnnnncnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcggtgggtctgagacagacttcactctcaccatcagcagactggagcctgaagattgtgcagtgtattactgtcagcagtatggtagctcaccccggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggncntgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctanttgnngttngtccaaactcatcangtatntnncatgtctggntcgggantnnngcgcagcncntgctgaannnacntctgaannagannnngttaggtaccttnngnnngnnnnnnn

SEQ ID NO: 3401 - DNA, 325 bp, Artificial Sequence; identical to SEQ ID NO: 238
  source: /note="Description of Artificial Sequence: Synthetic polynucleotide"

SEQ ID NO: 3402 - DNA, 1198 bp, Artificial Sequence
  source: /note="Description of Artificial Sequence: Synthetic polynucleotide"
  modified_base (1)..(11): a, c, t, g, unknown or other
  modified_base (13)..(13): a, c, t, g, unknown or other
  modified_base (16)..(17): a, c, t, g, unknown or other
  modified_base (20)..(20): a, c, t, g, unknown or other
  modified_base (24)..(24): a, c, t, g, unknown or other
  modified_base (932)..(932): a, c, t, g, unknown or other
  modified_base (996)..(996): a, c, t, g, unknown or other
  modified_base (998)..(998): a, c, t, g, unknown or other
  modified_base (1004)..(1005): a, c, t, g, unknown or other
  modified_base (1013)..(1013): a, c, t, g, unknown or other
  modified_base (1019)..(1019): a, c, t, g, unknown or other
  modified_base (1026)..(1027): a, c, t, g, unknown or other
  modified_base (1033)..(1035): a, c, t, g, unknown or other
  modified_base (1043)..(1043): a, c, t, g, unknown or other
  modified_base (1048)..(1048): a, c, t, g, unknown or other
  modified_base (1050)..(1050): a, c, t, g, unknown or other
  modified_base (1055)..(1055): a, c, t, g, unknown or other
  modified_base (1067)..(1067): a, c, t, g, unknown or other
  modified_base (1070)..(1070): a, c, t, g, unknown or other
  modified_base (1072)..(1072): a, c, t, g, unknown or other
  modified_base (1083)..(1086): a, c, t, g, unknown or other
  modified_base (1088)..(1088): a, c, t, g, unknown or other
  modified_base (1097)..(1100): a, c, t, g, unknown or other
  modified_base (1102)..(1103): a, c, t, g, unknown or other
  modified_base (1105)..(1105): a, c, t, g, unknown or other
  modified_base (1108)..(1110): a, c, t, g, unknown or other
  modified_base (1115)..(1118): a, c, t, g, unknown or other
  modified_base (1120)..(1127): a, c, t, g, unknown or other
  modified_base (1129)..(1129): a, c, t, g, unknown or other
  modified_base (1131)..(1133): a, c, t, g, unknown or other
  modified_base (1137)..(1137): a, c, t, g, unknown or other
  modified_base (1142)..(1142): a, c, t, g, unknown or other
  modified_base (1145)..(1145): a, c, t, g, unknown or other
  modified_base (1147)..(1149): a, c, t, g, unknown or other
  modified_base (1152)..(1153): a, c, t, g, unknown or other
  modified_base (1159)..(1159): a, c, t, g, unknown or other
  modified_base (1161)..(1161): a, c, t, g, unknown or other
  modified_base (1163)..(1163): a, c, t, g, unknown or other
  modified_base (1168)..(1168): a, c, t, g, unknown or other
  modified_base (1170)..(1170): a, c, t, g, unknown or other
  modified_base (1172)..(1176): a, c, t, g, unknown or other
  modified_base (1180)..(1181): a, c, t, g, unknown or other
  modified_base (1183)..(1185): a, c, t, g, unknown or other
  modified_base (1187)..(1191): a, c, t, g, unknown or other
  modified_base (1195)..(1196): a, c, t, g, unknown or other
  modified_base (1198)..(1198): a, c, t, g, unknown or other
nnnnnnnnnnntntgnntcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagggactacggtgactactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaangacaccctcatgatctcccggacccctgaggtcacatgcgtggtggtggacgtgagccacgaanancctganncaagttcnactggnacgtggnnggcgtnnngtgcatangccananaagcngcggaggagcantananagcacgtacgnnnngncagcgtccnnnncnncngcnnngactnnnnannnnnnnnanannncagnctcanaancnnnccnnccccancnanaaaancntnnnnnagcnnannngnnnnncccnnan

SEQ ID NO: 3403 - DNA, 352 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcatcgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagggactacggtgactactactttgactactggggccagggaaccctggtcaccgtctcctcag

SEQ ID NO: 3404 - DNA, 1045 bp, Artificial Sequence
  source: /note="Description of Artificial Sequence: Synthetic polynucleotide"
  modified_base (1)..(7): a, c, t, g, unknown or other
  modified_base (9)..(9): a, c, t, g, unknown or other
  modified_base (18)..(18): a, c, t, g, unknown or other
  modified_base (785)..(785): a, c, t, g, unknown or other
  modified_base (788)..(788): a, c, t, g, unknown or other
  modified_base (852)..(852): a, c, t, g, unknown or other
  modified_base (881)..(881): a, c, t, g, unknown or other
  modified_base (947)..(947): a, c, t, g, unknown or other
  modified_base (950)..(950): a, c, t, g, unknown or other
  modified_base (970)..(970): a, c, t, g, unknown or other
  modified_base (973)..(973): a, c, t, g, unknown or other
  modified_base (975)..(975): a, c, t, g, unknown or other
  modified_base (986)..(986): a, c, t, g, unknown or other
  modified_base (992)..(992): a, c, t, g, unknown or other
  modified_base (995)..(995): a, c, t, g, unknown or other
  modified_base (1000)..(1002): a, c, t, g, unknown or other
  modified_base (1011)..(1011): a, c, t, g, unknown or other
  modified_base (1015)..(1016): a, c, t, g, unknown or other
  modified_base (1022)..(1023): a, c, t, g, unknown or other
  modified_base (1028)..(1029): a, c, t, g, unknown or other
  modified_base (1034)..(1036): a, c, t, g, unknown or other
  modified_base (1038)..(1039): a, c, t, g, unknown or other
  modified_base (1042)..(1043): a, c, t, g, unknown or other
  modified_base (1045)..(1045): a, c, t, g, unknown or other
nnnnnnncntatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtctattactgtcagcagtatggtagctcacctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggncctgagctcgcccgtcacaaagagcttcaacaggggagagtgttagaagcttggccgccatggnccaacttgtttattgcagcttataatggntacaaataaagcaatagcatcacaaatttcacaaataaagcatttttttcactgcattctagttgnggnttgtccaaactcatcaatgnatntntcatgtctggntcgggnatnattcnnngcagcaccntggnntgaaannacctnntgaannngnnctnngn

SEQ ID NO: 3405 - DNA, 325 bp, Artificial Sequence; identical to SEQ ID NO: 240
  source: /note="Description of Artificial Sequence: Synthetic polynucleotide"

SEQ ID NO: 3406 - DNA, 1208 bp, Artificial Sequence
  source: /note="Description of Artificial Sequence: Synthetic polynucleotide"
  modified_base (1)..(12): a, c, t, g, unknown or other
  modified_base (15)..(16): a, c, t, g, unknown or other
  modified_base (19)..(19): a, c, t, g, unknown or other
  modified_base (993)..(993): a, c, t, g, unknown or other
  modified_base (999)..(999): a, c, t, g, unknown or other
  modified_base (1013)..(1013): a, c, t, g, unknown or other
  modified_base (1021)..(1022): a, c, t, g, unknown or other
  modified_base (1036)..(1036): a, c, t, g, unknown or other
  modified_base (1039)..(1039): a, c, t, g, unknown or other
  modified_base (1042)..(1043): a, c, t, g, unknown or other
  modified_base (1047)..(1052): a, c, t, g, unknown or other
  modified_base (1058)..(1058): a, c, t, g, unknown or other
  modified_base (1063)..(1063): a, c, t, g, unknown or other
  modified_base (1067)..(1067): a, c, t, g, unknown or other
  modified_base (1073)..(1073): a, c, t, g, unknown or other
  modified_base (1077)..(1077): a, c, t, g, unknown or other
  modified_base (1080)..(1080): a, c, t, g, unknown or other
  modified_base (1082)..(1082): a, c, t, g, unknown or other
  modified_base (1085)..(1085): a, c, t, g, unknown or other
  modified_base (1088)..(1088): a, c, t, g, unknown or other
  modified_base (1090)..(1091): a, c, t, g, unknown or other
  modified_base (1094)..(1094): a, c, t, g, unknown or other
  modified_base (1100)..(1106): a, c, t, g, unknown or other
  modified_base (1110)..(1110): a, c, t, g, unknown or other
  modified_base (1113)..(1115): a, c, t, g, unknown or other
  modified_base (1117)..(1119): a, c, t, g, unknown or other
  modified_base (1121)..(1121): a, c, t, g, unknown or other
  modified_base (1124)..(1124): a, c, t, g, unknown or other
  modified_base (1127)..(1128): a, c, t, g, unknown or other
  modified_base (1132)..(1135): a, c, t, g, unknown or other
  modified_base (1137)..(1142): a, c, t, g, unknown or other
  modified_base (1144)..(1154): a, c, t, g, unknown or other
  modified_base (1157)..(1159): a, c, t, g, unknown or other
  modified_base (1162)..(1163): a, c, t, g, unknown or other
  modified_base (1165)..(1166): a, c, t, g, unknown or other
  modified_base (1168)..(1170): a, c, t, g, unknown or other
  modified_base (1173)..(1176): a, c, t, g, unknown or other
  modified_base (1179)..(1179): a, c, t, g, unknown or other
  modified_base (1182)..(1182): a, c, t, g, unknown or other
  modified_base (1184)..(1185): a, c, t, g, unknown or other
  modified_base (1187)..(1189): a, c, t, g, unknown or other
  modified_base (1191)..(1194): a, c, t, g, unknown or other
  modified_base (1197)..(1200): a, c, t, g, unknown or other
  modified_base (1206)..(1208): a, c, t, g, unknown or other
nnnnnnnnnnnntgnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccggctacaagccgtccctcaagagtcgagtcaccatatcagtagacatgtccaggaaccagttctccctgaaggtgacctctgtgaccgccgcggacacggctgtgtattactgtgcgagaaagcccctcctctacagtgacttctctcctggtgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggnggtggncgtgagccacgaanaccctganncaagttcaactggnacntgnnggcnnnnnngcatangccangaanaagccncggnagnancantananngcncgtacnnnnnnnagcntcnnncnnncngcncannactnnnnannnnnngnnnnnnnnnnnagnnncannanncnnnccnnnnccntcnannannntnnnnaannnnaagggnnn

SEQ ID NO: 3407 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccggctacaagccgtccctcaagagtcgagtcaccatatcagtagacatgtccaggaaccagttctccctgaaggtgacctctgtgaccgccgcggacacggctgtgtattactgtgcgagaaagcccctcctctacagtgacttctctcctggtgcttttgatatctggggccaagggacaatggtcgccgtctcttcag

SEQ ID NO: 3408 - DNA, 1036 bp, Artificial Sequence
  source: /note="Description of Artificial Sequence: Synthetic polynucleotide"
  modified_base (1)..(11): a, c, t, g, unknown or other
  modified_base (19)..(19): a, c, t, g, unknown or other
  modified_base (827)..(827): a, c, t, g, unknown or other
  modified_base (844)..(844): a, c, t, g, unknown or other
  modified_base (853)..(853): a, c, t, g, unknown or other
  modified_base (882)..(882): a, c, t, g, unknown or other
  modified_base (887)..(887): a, c, t, g, unknown or other
  modified_base (952)..(952): a, c, t, g, unknown or other
  modified_base (954)..(954): a, c, t, g, unknown or other
  modified_base (956)..(956): a, c, t, g, unknown or other
  modified_base (972)..(972): a, c, t, g, unknown or other
  modified_base (975)..(975): a, c, t, g, unknown or other
  modified_base (977)..(977): a, c, t, g, unknown or other
  modified_base (989)..(989): a, c, t, g, unknown or other
  modified_base (994)..(994): a, c, t, g, unknown or other
  modified_base (1006)..(1006): a, c, t, g, unknown or other
  modified_base (1008)..(1009): a, c, t, g, unknown or other
  modified_base (1012)..(1015): a, c, t, g, unknown or other
  modified_base (1020)..(1021): a, c, t, g, unknown or other
  modified_base (1026)..(1027): a, c, t, g, unknown or other
  modified_base (1030)..(1034): a, c, t, g, unknown or other
  modified_base (1036)..(1036): a, c, t, g, unknown or other
nnnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagactgttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatactactacacctcggactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacagggganagtgttagaagcttggncgccatggnccaacttgtttattgcagcttataatggnttacnaataaagcaatagcatcacaaatttcacaaataaagcatttttttcactgcattctagttgtggntngnccaaactcatcaatgnatntnatcatgtctggntcggnaattaattcggngnngcnnnnatggnntgaannacnnnnngn

SEQ ID NO: 3409 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactgttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatactactacacctcggactttcggcggagggaccaaggtggagatcaa

SEQ ID NO: 3410 - DNA, 1058 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (17)..(17): a, c, t, g, unknown or other
  modified_base (23)..(23): a, c, t, g, unknown or other
  modified_base (831)..(831): a, c, t, g, unknown or other
  modified_base (833)..(833): a, c, t, g, unknown or other
  modified_base (844)..(844): a, c, t, g, unknown or other
  modified_base (902)..(902): a, c, t, g, unknown or other
  modified_base (944)..(944): a, c, t, g, unknown or other
  modified_base (949)..(949): a, c, t, g, unknown or other
  modified_base (965)..(967): a, c, t, g, unknown or other
  modified_base (971)..(971): a, c, t, g, unknown or other
  modified_base (974)..(976): a, c, t, g, unknown or other
  modified_base (988)..(988): a, c, t, g, unknown or other
  modified_base (990)..(992): a, c, t, g, unknown or other
  modified_base (994)..(995): a, c, t, g, unknown or other
  modified_base (1005)..(1005): a, c, t, g, unknown or other
  modified_base (1007)..(1007): a, c, t, g, unknown or other
  modified_base (1030)..(1030): a, c, t, g, unknown or other
  modified_base (1033)..(1035): a, c, t, g, unknown or other
  modified_base (1037)..(1039): a, c, t, g, unknown or other
  modified_base (1045)..(1048): a, c, t, g, unknown or other
  modified_base (1050)..(1050): a, c, t, g, unknown or other
  modified_base (1055)..(1058): a, c, t, g, unknown or other
nnnnnncnnatgtatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctctcctgcgctgtctatggtgggtccctcagtggttactactggagctggatccgccagcccccagggaaggggctggagtggattggggagatcaatcattttggaagcaccggctacaacccgtccctcaagagtcgagtcaccatctccgtggacacgtccaagagccagttctccgtgaagctgagctctgtgaccgccgcggacacggctgtctattactgcgcgagaaagcccctcctctacagtaacttatcccctggtgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnangtggacaaganagttgagcccaaatcttgtgacaaaactcacacatgcccaccgtgcccagcacctgantcctggggggaccgtcagtcttcctcttccccccaaaacccnagganaccctcatgatctccnnncccntgnnncacatgcgtggngnnngnngtgagccacnanaccctgagtcaagttcaactggnacnnngnnnggcgtnnnngntgcannnn

SEQ ID NO: 3411 - DNA, 370 bp, Artificial Sequence
  source: /note="Description of Artificial Sequence: Synthetic polynucleotide"
caggtgcagctacagcagtggggcgcaggactgttgaagccttcggagaccctgtccctctcctgcgctgtctatggtgggtccctcagtggttactactggagctggatccgccagcccccagggaaggggctggagtggattggggagatcaatcattttggaagcaccggctacaacccgtccctcaagagtcgagtcaccatctccgtggacacgtccaagagccagttctccgtgaagctgagctctgtgaccgccgcggacacggctgtctattactgtgcgagaaagcccctcctctacagtaacttatcccctggtgcttttgatatctggggccaagggacaatggtcaccgtctcttcag

SEQ ID NO: 3412 - DNA, 1047 bp, Artificial Sequence
  source: /note="Description of Artificial Sequence: Synthetic polynucleotide"
  modified_base (1)..(11): a, c, t, g, unknown or other
  modified_base (16)..(16): a, c, t, g, unknown or other
  modified_base (20)..(20): a, c, t, g, unknown or other
  modified_base (1001)..(1001): a, c, t, g, unknown or other
  modified_base (1006)..(1006): a, c, t, g, unknown or other
  modified_base (1015)..(1015): a, c, t, g, unknown or other
  modified_base (1020)..(1020): a, c, t, g, unknown or other
  modified_base (1027)..(1027): a, c, t, g, unknown or other
  modified_base (1040)..(1040): a, c, t, g, unknown or other
nnnnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccgtgtctttgtctccaggggaaagagccaccctctcctgctgggccagtcagagtgttagcgccagctacttagcctggtaccagcagaaacctggccaggctcccaggctcctcatctatggtgcatccagcagggccactggcatcccagacaggttcagtggcagtgggtctgggacagacttcactctcaccatcagtagactggagcctgaagattttgcagtatattactgtcagcagtacggtactacacctcggactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggatcgggaattaanttcgncgcagcacntggcntgaaatnacctctgaaagangaacttg

SEQ ID NO: 3413 - DNA, 325 bp, Artificial Sequence
  source: /note="Description of Artificial Sequence: Synthetic polynucleotide"
gaaattgtgttgacgcagtctccaggcaccctgtctttgtctccaggggaaagagccaccctctcctgctgggccagtcagagtgttagcgccagctacttagcctggtaccagcagaaacctggccaggctcccaggctcctcatctatggtgcatccagcagggccactggcatcccagacaggttcagtggcagtgggtctgggacagacttcactctcaccatcagtagactggagcctgaagattttgcagtatattactgtcagcagtacggtactacacctcggactttcggcggagggaccaaggtggagatcaaac

SEQ ID NO: 3414 - DNA, 1024 bp, Artificial Sequence
  source: /note="Description of Artificial Sequence: Synthetic polynucleotide"
  modified_base (1)..(11): a, c, t, g, unknown or other
  modified_base (722)..(722): a, c, t, g, unknown or other
  modified_base (819)..(820): a, c, t, g, unknown or other
  modified_base (831)..(831): a, c, t, g, unknown or other
  modified_base (917)..(917): a, c, t, g, unknown or other
  modified_base (932)..(934): a, c, t, g, unknown or other
  modified_base (940)..(940): a, c, t, g, unknown or other
  modified_base (949)..(949): a, c, t, g, unknown or other
  modified_base (952)..(953): a, c, t, g, unknown or other
  modified_base (958)..(958): a, c, t, g, unknown or other
  modified_base (964)..(967): a, c, t, g, unknown or other
  modified_base (970)..(973): a, c, t, g, unknown or other
  modified_base (976)..(976): a, c, t, g, unknown or other
  modified_base (979)..(980): a, c, t, g, unknown or other
  modified_base (982)..(983): a, c, t, g, unknown or other
  modified_base (988)..(988): a, c, t, g, unknown or other
  modified_base (990)..(993): a, c, t, g, unknown or other
  modified_base (995)..(995): a, c, t, g, unknown or other
  modified_base (1002)..(1004): a, c, t, g, unknown or other
  modified_base (1016)..(1016): a, c, t, g, unknown or other
  modified_base (1020)..(1020): a, c, t, g, unknown or other
  modified_base (1023)..(1024): a, c, t, g, unknown or other
nnnnnnnnnnnatgtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagaggcgaggggtgggagctaccatacgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccanngtggacaaganagttgagcccaaatcttgtgacaaaactcacacatgcccaccgtgcccagcacctgaactcctggggggaccgtcagtcttcctcntccccccaaaacccnnncacccncatgatctnccnnacccngagtcnnnntgnnnnggnggnngnngtgancnnnnanaccctgnnngtcaagttcaantggnacnn

SEQ ID NO: 3415 - DNA, 355 bp, Artificial Sequence
  source: /note="Description of Artificial Sequence: Synthetic polynucleotide"
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagaggcgaggggtgggagctaccatacgactactggggccagggaaccctggtcaccgtctcctcag

SEQ ID NO: 3416 - DNA, 1023 bp, Artificial Sequence
  source: /note="Description of Artificial Sequence: Synthetic polynucleotide"
  modified_base (1)..(8): a, c, t, g, unknown or other
  modified_base (17)..(17): a, c, t, g, unknown or other
  modified_base (793)..(793): a, c, t, g, unknown or other
  modified_base (809)..(810): a, c, t, g, unknown or other
  modified_base (887)..(887): a, c, t, g, unknown or other
  modified_base (891)..(891): a, c, t, g, unknown or other
  modified_base (948)..(948): a, c, t, g, unknown or other
  modified_base (953)..(953): a, c, t, g, unknown or other
  modified_base (955)..(955): a, c, t, g, unknown or other
  modified_base (957)..(957): a, c, t, g, unknown or other
  modified_base (971)..(971): a, c, t, g, unknown or other
  modified_base (975)..(977): a, c, t, g, unknown or other
  modified_base (992)..(992): a, c, t, g, unknown or other
  modified_base (1004)..(1004): a, c, t, g, unknown or other
  modified_base (1006)..(1007): a, c, t, g, unknown or other
  modified_base (1009)..(1010): a, c, t, g, unknown or other
  modified_base (1016)..(1017): a, c, t, g, unknown or other
  modified_base (1019)..(1021): a, c, t, g, unknown or other
  modified_base (1023)..(1023): a, c, t, g, unknown or other
nnnnnnnntatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctccctccgcgtccgggtctcctggacagtcagtcaccatctcctgcactggaaccagcagtgacgttggtggttataagtatgtctcctggtaccaacagcacccaggcaaagcccccaaactcatgatttatgaggtcagtaagcggccctcaggggtccctgatcgcttctctggctccaagtctggcaacacggcctccctgaccgtttctgggctccaggctgaggatgaggctgattattactgcagctcatatgaaggcagcaacaattttgtggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgnaagggagcaccgtggnnaagacagtggcccctacagaatgttcatagaagcttggccgccatggcccaacttgtttattgcagcttataatggntacnaataaagcatagcatcacaaatttcacaaataaagcatttttttcactgcattctanttgtngntngtccaaactcatcnatgnnncttatcatgtctggntcgggaattaantnngnngcagcnncnnngn

SEQ ID NO: 3417 - DNA, 334 bp, Artificial Sequence
  source: /note="Description of Artificial Sequence: Synthetic polynucleotide"
cagtctgtgctgactcagcctccctccgcgtccgggtctcctggacagtcagtcaccatctcctgcactggaaccagcagtgacgttggtggttataagtatgtctcctggtaccaacagcacccaggcaaagcccccaaactcatgatttatgaggtcagtaagcggccctcaggggtccctgatcgcttctctggctccaagtctggcaacacggcctccctgaccgtttctgggctccaggctgaggatgaggctgattattactgcagctcatatgaaggcagcaacaattttgtggtattcggcggagggaccaagctgaccgtcctag

SEQ ID NO: 3418 - DNA, 1226 bp, Artificial Sequence
  source: /note="Description of Artificial Sequence: Synthetic polynucleotide"
  modified_base (1)..(9): a, c, t, g, unknown or other
  modified_base (14)..(14): a, c, t, g, unknown or other
  modified_base (18)..(18): a, c, t, g, unknown or other
  modified_base (763)..(763): a, c, t, g, unknown or other
  modified_base (943)..(943): a, c, t, g, unknown or other
  modified_base (1016)..(1020): a, c, t, g, unknown or other
  modified_base (1023)..(1023): a, c, t, g, unknown or other
  modified_base (1028)..(1028): a, c, t, g, unknown or other
  modified_base (1036)..(1036): a, c, t, g, unknown or other
  modified_base (1045)..(1045): a, c, t, g, unknown or other
  modified_base (1058)..(1058): a, c, t, g, unknown or other
  modified_base (1063)..(1068): a, c, t, g, unknown or other
  modified_base (1070)..(1074): a, c, t, g, unknown or other
  modified_base (1078)..(1078): a, c, t, g, unknown or other
  modified_base (1080)..(1081): a, c, t, g, unknown or other
  modified_base (1084)..(1085): a, c, t, g, unknown or other
  modified_base (1088)..(1088): a, c, t, g, unknown or other
  modified_base (1093)..(1096): a, c, t, g, unknown or other
  modified_base (1100)..(1100): a, c, t, g, unknown or other
  modified_base (1103)..(1103): a, c, t, g, unknown or other
  modified_base (1106)..(1106): a, c, t, g, unknown or other
  modified_base (1108)..(1109): a, c, t, g, unknown or other
  modified_base (1111)..(1114): a, c, t, g, unknown or other
  modified_base (1117)..(1119): a, c, t, g, unknown or other
  modified_base (1121)..(1127): a, c, t, g, unknown or other
  modified_base (1129)..(1130): a, c, t, g, unknown or other
  modified_base (1134)..(1134): a, c, t, g, unknown or other
  modified_base (1137)..(1137): a, c, t, g, unknown or other
  modified_base (1139)..(1140): a, c, t, g, unknown or other
  modified_base (1143)..(1144): a, c, t, g, unknown or other
  modified_base (1146)..(1150): a, c, t, g, unknown or other
  modified_base (1152)..(1155): a, c, t, g, unknown or other
  modified_base (1157)..(1159): a, c, t, g, unknown or other
  modified_base (1161)..(1161): a, c, t, g, unknown or other
  modified_base (1163)..(1167): a, c, t, g, unknown or other
  modified_base (1169)..(1172): a, c, t, g, unknown or other
  modified_base (1174)..(1183): a, c, t, g, unknown or other
  modified_base (1185)..(1189): a, c, t, g, unknown or other
  modified_base (1192)..(1194): a, c, t, g, unknown or other
  modified_base (1196)..(1199): a, c, t, g, unknown or other
  modified_base (1205)..(1207): a, c, t, g, unknown or other
  modified_base (1209)..(1209): a, c, t, g, unknown or other
  modified_base (1212)..(1212): a, c, t, g, unknown or other
  modified_base (1214)..(1219): a, c, t, g, unknown or other
  modified_base (1221)..(1226): a, c, t, g, unknown or other
nnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccagctgcagctgcaggagtcgggcccaggactggtgaagccttcggagaccctgtccctcacctgcactgtctctggtgcctccgtcagcagtggtagttactactggagctggatccggcagcccccagggaagggactggaatggattgggtatatctattacagtgggagcaccaactacaacccctccctcaagagtcgagtcaccatatcagtggacacgtccaagaaccagttctccctgaagctgagctctgtgaccgctgcggacacggccgtgtattactgtgcgagagagcggcccggtggaacgtatagcaacacctggtacaccccaaccgataccaactggttcgacacctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggancgtcagtcttcctcttccccccaaaacccaaggacaccctcatgatctcccggacccctgagtcacatgcgtnnnnngangtganccacgaanaccctgagncaagttcactggnacgtnnnnnntnnnnncatnanncannaanaagcnnnnggangancantnnannnnacnnncnnnnnnngnnagcntcntnncgnncnnnnncnnnntnnntnannnnngnnnnannnnnnnnnncnnnnnccnnncnnnnccatcnnnanccntnnnnnnannnnnn

SEQ ID NO: 3419 - DNA, 397 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctggtgcctccgtcagcagtggtagttactactggagctggatccggcagcccccagggaagggactggaatggattgggtatatctattacagtgggagcaccaactacaacccctccctcaagagtcgagtcaccatatcagtggacacgtccaagaaccagttctccctgaagctgagctctgtgaccgctgcggacacggccgtgtattactgtgcgagagagcggcccggtggaacgtatagcaacacctggtacaccccaaccgataccaactggttcgacacctggggccagggaaccctggtcaccgtctcctcag

SEQ ID NO: 3420 - DNA, 1041 bp, Artificial Sequence
  source: /note="Description of Artificial Sequence: Synthetic polynucleotide"
  modified_base (1)..(10): a, c, t, g, unknown or other
  modified_base (18)..(18): a, c, t, g, unknown or other
  modified_base (940)..(940): a, c, t, g, unknown or other
  modified_base (1000)..(1000): a, c, t, g, unknown or other
  modified_base (1013)..(1015): a, c, t, g, unknown or other
  modified_base (1036)..(1036): a, c, t, g, unknown or other
  modified_base (1040)..(1041): a, c, t, g, unknown or other
nnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattttgatagcgaccggccctcagggatccctgagcgattctctggctccaactctgggaacacggccaccctgaccatcagcagggtcgaagccggggatgaggccgactattactgtcaggtgtgggatagtagtcgtgatcatgtggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctanttgtggtttgtccaaactcatcaatgtatcttatcatgtctggatcgggaattaattcgncgcagcaccatgnnntgaaataacctctgaaagagnaacnn

SEQ ID NO: 3421 - DNA, 325 bp, Artificial Sequence
  source: /note="Description of Artificial Sequence: Synthetic polynucleotide"
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattttgatagcgaccggccctcagggatccctgagcgattctctggctccaactctgggaacacggccaccctgaccatcagcagggtcgaagccggggatgaggccgactattactgtcaggtgtgggatagtagtcgtgatcatgtggtattcggcggagggaccaagctgaccgtcctag

SEQ ID NO: 3422 - DNA, 1044 bp, Artificial Sequence
  source: /note="Description of Artificial Sequence: Synthetic polynucleotide"
  modified_base (1)..(9): a, c, t, g, unknown or other
  modified_base (17)..(17): a, c, t, g, unknown or other
  modified_base (828)..(828): a, c, t, g, unknown or other
  modified_base (842)..(842): a, c, t, g, unknown or other
  modified_base (903)..(903): a, c, t, g, unknown or other
  modified_base (936)..(936): a, c, t, g, unknown or other
  modified_base (950)..(950): a, c, t, g, unknown or other
  modified_base (960)..(960): a, c, t, g, unknown or other
  modified_base (962)..(962): a, c, t, g, unknown or other
  modified_base (965)..(965): a, c, t, g, unknown or other
  modified_base (971)..(971): a, c, t, g, unknown or other
  modified_base (983)..(984): a, c, t, g, unknown or other
  modified_base (987)..(987): a, c, t, g, unknown or other
  modified_base (992)..(992): a, c, t, g, unknown or other
  modified_base (995)..(995): a, c, t, g, unknown or other
  modified_base (1000)..(1001): a, c, t, g, unknown or other
  modified_base (1006)..(1006): a, c, t, g, unknown or other
  modified_base (1009)..(1010): a, c, t, g, unknown or other
  modified_base (1014)..(1015): a, c, t, g, unknown or other
  modified_base (1017)..(1017): a, c, t, g, unknown or other
  modified_base (1032)..(1032): a, c, t, g, unknown or other
  modified_base (1035)..(1035): a, c, t, g, unknown or other
  modified_base (1038)..(1040): a, c, t, g, unknown or other
  modified_base (1042)..(1044): a, c, t, g, unknown or other
nnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggttcagctggtgcagtctggagctgaggtgaagaagcctggggcctcagtgagggtctcctgcaaggcttctggttacacctttaccagctatggtttcagctgggtgcgacaggcccctggacaagggcttgagtggatgggatggatcagcgcttacaatggtaacacaaactttgcacagaagctccagggcagagtcaccatgaccacagacacatccacgagcacagcctacatggagctgaggagcctgagatctgacgacacggccgtgtattactgtgcgagaggggaagcagtggctggtacaaccggtttttttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaaggtggacaaganagttgagcccaaatcttgtgacaaaactcacacatgcccaccgtgcccagcacctgaactnctggggggaccgtcagtcttcctcttccccccnaaacccaaggacancctcatgatntnccngacccntgagtcacatgnngtngtggnggncgtgnnccacnaannaccnngnaggtcaagttcaacnggnacnnngnnn

SEQ ID NO: 3423 - DNA, 367 bp, Artificial Sequence; identical to SEQ ID NO: 249
  source: /note="Description of Artificial Sequence: Synthetic polynucleotide"

SEQ ID NO: 3424 - DNA, 1130 bp, Artificial Sequence
  source: /note="Description of Artificial Sequence: Synthetic polynucleotide"
  modified_base (1)..(15): a, c, t, g, unknown or other
  modified_base (17)..(17): a, c, t, g, unknown or other
  modified_base (26)..(26): a, c, t, g, unknown or other
  modified_base (955)..(955): a, c, t, g, unknown or other
  modified_base (958)..(958): a, c, t, g, unknown or other
  modified_base (983)..(983): a, c, t, g, unknown or other
  modified_base (995)..(995): a, c, t, g, unknown or other
  modified_base (998)..(998): a, c, t, g, unknown or other
  modified_base (1003)..(1003): a, c, t, g, unknown or other
  modified_base (1010)..(1010): a, c, t, g, unknown or other
  modified_base (1026)..(1026): a, c, t, g, unknown or other
  modified_base (1032)..(1033): a, c, t, g, unknown or other
  modified_base (1047)..(1048): a, c, t, g, unknown or other
  modified_base (1050)..(1053): a, c, t, g, unknown or other
  modified_base (1055)..(1056): a, c, t, g, unknown or other
  modified_base (1058)..(1059): a, c, t, g, unknown or other
  modified_base (1062)..(1063): a, c, t, g, unknown or other
  modified_base (1065)..(1072): a, c, t, g, unknown or other
  modified_base (1075)..(1075): a, c, t, g, unknown or other
  modified_base (1077)..(1077): a, c, t, g, unknown or other
  modified_base (1080)..(1082): a, c, t, g, unknown or other
  modified_base (1084)..(1084): a, c, t, g, unknown or other
  modified_base (1086)..(1086): a, c, t, g, unknown or other
  modified_base (1090)..(1090): a, c, t, g, unknown or other
  modified_base (1092)..(1097): a, c, t, g, unknown or other
  modified_base (1103)..(1103): a, c, t, g, unknown or other
  modified_base (1108)..(1108): a, c, t, g, unknown or other
  modified_base (1110)..(1112): a, c, t, g, unknown or other
  modified_base (1116)..(1117): a, c, t, g, unknown or other
  modified_base (1121)..(1123): a, c, t, g, unknown or other
  modified_base (1125)..(1127): a, c, t, g, unknown or other
  modified_base (1130)..(1130): a, c, t, g, unknown or other
nnnnnnnnnnnnnnngnatctacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttttgtggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctagttgnggnttgtccaaactcatcaatgtatctnatcatgtctggntcngggantaattcngcgcagcaccatggcntgaaannacctctgaaagagnntnnnngnncnnctnngnnnnnnnntcngngannngngntcantnnnnnngaaagnccccngnnncccnncagnnnannntgn

SEQ ID NO: 3425 - DNA, 334 bp, Artificial Sequence; identical to SEQ ID NO: 250
  source: /note="Description of Artificial Sequence: Synthetic polynucleotide"

SEQ ID NO: 3426 - DNA, 1049 bp, Artificial Sequence
  source: /note="Description of Artificial Sequence: Synthetic polynucleotide"
  modified_base (1)..(7): a, c, t, g, unknown or other
  modified_base (9)..(9): a, c, t, g, unknown or other
  modified_base (14)..(14): a, c, t, g, unknown or other
  modified_base (18)..(18): a, c, t, g, unknown or other
  modified_base (836)..(836): a, c, t, g, unknown or other
  modified_base (897)..(897): a, c, t, g, unknown or other
  modified_base (932)..(932): a, c, t, g, unknown or other
  modified_base (935)..(935): a, c, t, g, unknown or other
  modified_base (954)..(954): a, c, t, g, unknown or other
  modified_base (957)..(957): a, c, t, g, unknown or other
  modified_base (979)..(984): a, c, t, g, unknown or other
  modified_base (994)..(994): a, c, t, g, unknown or other
  modified_base (996)..(996): a, c, t, g, unknown or other
  modified_base (998)..(998): a, c, t, g, unknown or other
  modified_base (1018)..(1018): a, c, t, g, unknown or other
  modified_base (1022)..(1023): a, c, t, g, unknown or other
  modified_base (1025)..(1026): a, c, t, g, unknown or other
  modified_base (1029)..(1032): a, c, t, g, unknown or other
  modified_base (1035)..(1036): a, c, t, g, unknown or other
  modified_base (1038)..(1039): a, c, t, g, unknown or other
  modified_base (1044)..(1044): a, c, t, g, unknown or other
  modified_base (1048)..(1049): a, c, t, g, unknown or other
nnnnnnncntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctgcaggagtcgggcccaggactggtgaagccttcggggaccctgtccctcacctgcgctgtctctggtggctccatcagcagtactaactggtggagttgggtccgccagcccccagggaaggggctggagtggattggggaaatctatcatactgggagcaccaactacaacccgtccctcaagagtcgagtcaccatatcagtagacaagtccaagaaccagttctccctgaagctgagctctgtgaccgccgcggacacggccgtgtattactgtgtgagagatggaggacgacccggggatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaaganagttgagcccaaatcttgtgacaaaactcacacatgcccaccgtgcccagcacctgaactnctggggggaccgtcagtcttcctcttcccccaaanccnaggacaccctcatgatctnccngaccctgagtcacatgcgtggnnnnnngtgagccacnanancctgagtcagttcaactggnacgnngnnggnnnnggnngnngcatnatgnn

SEQ ID NO: 3427 - DNA, 361 bp, Artificial Sequence; identical to SEQ ID NO: 251
  source: /note="Description of Artificial Sequence: Synthetic polynucleotide"

SEQ ID NO: 3428 - DNA, 1043 bp, Artificial Sequence
  source: /note="Description of Artificial Sequence: Synthetic polynucleotide"
  modified_base (1)..(9): a, c, t, g, unknown or other
  modified_base (19)..(19): a, c, t, g, unknown or other
  modified_base (23)..(23): a, c, t, g, unknown or other
  modified_base (794)..(794): a, c, t, g, unknown or other
  modified_base (857)..(857): a, c, t, g, unknown or other
  modified_base (936)..(936): a, c, t, g, unknown or other
  modified_base (948)..(948): a, c, t, g, unknown or other
  modified_base (950)..(950): a, c, t, g, unknown or other
  modified_base (957)..(957): a, c, t, g, unknown or other
  modified_base (964)..(964): a, c, t, g, unknown or other
  modified_base (977)..(979): a, c, t, g, unknown or other
  modified_base (990)..(990): a, c, t, g, unknown or other
  modified_base (996)..(996): a, c, t, g, unknown or other
  modified_base (1006)..(1006): a, c, t, g, unknown or other
  modified_base (1017)..(1017): a, c, t, g, unknown or other
  modified_base (1026)..(1028): a, c, t, g, unknown or other
  modified_base (1035)..(1036): a, c, t, g, unknown or other
  modified_base (1039)..(1040): a, c, t, g, unknown or other
  modified_base (1042)..(1043): a, c, t, g, unknown or other
nnnnnnnnnttatgtatcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcaactcatatacaagcagcagcactcgagtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaangggagcaccgtggagaagacagtggcccctacagaatgttcatagaagcttggccgccatggnccaacttgtttattgcagcttataatggttacaaataaagcaatagcatcacaaatttcacaaataaagcatttttttnactgcattctantngtggttngtccaantcatcaatgtatnnntcatgtctggntcgggnattaattcgncgcagcaccanggcctgaannnacctctnnaannann

SEQ ID NO: 3429 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcaactcatatacaagcagcagcactcgagtcttcggaactgggaccaaggtcaccgtcctag

SEQ ID NO: 3430 - DNA, 1063 bp, Artificial Sequence
  source: /note="Description of Artificial Sequence: Synthetic polynucleotide"
  modified_base (1)..(9): a, c, t, g, unknown or other
  modified_base (19)..(19): a, c, t, g, unknown or other
  modified_base (674)..(674): a, c, t, g, unknown or other
  modified_base (725)..(725): a, c, t, g, unknown or other
  modified_base (821)..(821): a, c, t, g, unknown or other
  modified_base (823)..(823): a, c, t, g, unknown or other
  modified_base (938)..(938): a, c, t, g, unknown or other
  modified_base (940)..(940): a, c, t, g, unknown or other
  modified_base (942)..(942): a, c, t, g, unknown or other
  modified_base (957)..(957): a, c, t, g, unknown or other
  modified_base (979)..(982): a, c, t, g, unknown or other
  modified_base (997)..(997): a, c, t, g, unknown or other
  modified_base (1006)..(1006): a, c, t, g, unknown or other
  modified_base (1020)..(1020): a, c, t, g, unknown or other
  modified_base (1023)..(1025): a, c, t, g, unknown or other
  modified_base (1027)..(1028): a, c, t, g, unknown or other
  modified_base (1030)..(1035): a, c, t, g, unknown or other
  modified_base (1037)..(1039): a, c, t, g, unknown or other
  modified_base (1048)..(1048): a, c, t, g, unknown or other
  modified_base (1051)..(1052): a, c, t, g, unknown or other
  modified_base (1055)..(1055): a, c, t, g, unknown or other
  modified_base (1062)..(1063): a, c, t, g, unknown or other
nnnnnnnnnttatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaagtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccggagacaacgccaagaactcactgtatctgcacatgaacagcctgagagccgaggacacggctgtgtattactgtgctatacagctatggttaagggggggctatgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgcccagcacctgaactcctggggggaccgtcagtcttcctcttccccccaaaacccaagnanancctcatgatctcccngacccctgagtcacatgcgtgnnnngacgtgagccacganaccctgagncaagttcaactggnacnnngnngnnnnnngnnngcataatgncannaanaaagccnn

SEQ ID NO: 3431 - DNA, 358 bp, Artificial Sequence
  source: /note="Description of Artificial Sequence: Synthetic polynucleotide"
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccggagacaacgccaagaactcactgtatctgcacatgaacagcctgagagccgaggacacggctgtgtattactgtgctatacagctatggttaagggggggctatgactactggggccagggaaccctggtcaccgtctcctcag

SEQ ID NO: 3432 - DNA, 1018 bp, Artificial Sequence
  source: /note="Description of Artificial Sequence: Synthetic polynucleotide"
  modified_base (1)..(14): a, c, t, g, unknown or other
  modified_base (23)..(23): a, c, t, g, unknown or other
  modified_base (650)..(650): a, c, t, g, unknown or other
  modified_base (800)..(800): a, c, t, g, unknown or other
  modified_base (817)..(817): a, c, t, g, unknown or other
  modified_base (891)..(891): a, c, t, g, unknown or other
  modified_base (895)..(895): a, c, t, g, unknown or other
  modified_base (922)..(923): a, c, t, g, unknown or other
  modified_base (927)..(927): a, c, t, g, unknown or other
  modified_base (949)..(950): a, c, t, g, unknown or other
  modified_base (953)..(953): a, c, t, g, unknown or other
  modified_base (955)..(955): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (966)..(967): a, c, t, g, unknown or other
  modified_base (976)..(976): a, c, t, g, unknown or other
  modified_base (980)..(980): a, c, t, g, unknown or other
  modified_base (997)..(997): a, c, t, g, unknown or other
  modified_base (999)..(999): a, c, t, g, unknown or other
  modified_base (1006)..(1006): a, c, t, g, unknown or other
  modified_base (1013)..(1018): a, c, t, g, unknown or other
nnnnnnnnnnnnnntatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatgcaggcagcaacaattatgtggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctgnaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatganggagcaccgtggagaanacagtggcccctacagaatgttcatagaagcttggccgccatggcccaacttgtttattgcagcttataatggntacnaataaagcaatagcatcacaaatttcnnaaanaaagcatttttttcactgcatnntantngnggnttntcnnaactcatcnatgnatcttatcatgtctggntnggaattnattcggnnnnnn

SEQ ID NO: 3433 - DNA, 334 bp, Artificial Sequence
  source: /note="Description of Artificial Sequence: Synthetic polynucleotide"
cagtctgtgctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatgcaggcagcaacaattatgtggtattcggcggagggaccaagctgaccgtcctag

SEQ ID NO: 3434 - DNA, 1039 bp, Artificial Sequence
  source: /note="Description of Artificial Sequence: Synthetic polynucleotide"
  modified_base (1)..(10): a, c, t, g, unknown or other
  modified_base (13)..(14): a, c, t, g, unknown or other
  modified_base (17)..(17): a, c, t, g, unknown or other
  modified_base (854)..(854): a, c, t, g, unknown or other
  modified_base (856)..(856): a, c, t, g, unknown or other
  modified_base (958)..(961): a, c, t, g, unknown or other
  modified_base (967)..(967): a, c, t, g, unknown or other
  modified_base (979)..(980): a, c, t, g, unknown or other
  modified_base (985)..(986): a, c, t, g, unknown or other
  modified_base (998)..(998): a, c, t, g, unknown or other
  modified_base (1002)..(1002): a, c, t, g, unknown or other
  modified_base (1004)..(1005): a, c, t, g, unknown or other
  modified_base (1008)..(1009): a, c, t, g, unknown or other
  modified_base (1013)..(1014): a, c, t, g, unknown or other
  modified_base (1017)..(1017): a, c, t, g, unknown or other
  modified_base (1019)..(1019): a, c, t, g, unknown or other
  modified_base (1021)..(1021): a, c, t, g, unknown or other
  modified_base (1026)..(1026): a, c, t, g, unknown or other
  modified_base (1028)..(1028): a, c, t, g, unknown or other
  modified_base (1030)..(1030): a, c, t, g, unknown or other
  modified_base (1038)..(1039): a, c, t, g, unknown or other
nnnnnnnnnntgnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtacagctgcagcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacatgcagtggagcagcctgaaggcctcggacaccgccatgtattactgtgcgagatcgttccgggacgacccccgtatagcagtggctggcccggctgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggananagagttgagcccaaatcttgtgacaaactcacacatgcccaccgtgcccagcacctgaactcctggggggaccgtcagtcttcctcttccccccaaaacccnnnncacccncatgatctcccnnacccnngagtcacatgcntggngnnggnngtgnnccncnanacccngnangtcaagtnn

SEQ ID NO: 3435 - DNA, 385 bp, Artificial Sequence
  source: /note="Description of Artificial Sequence: Synthetic polynucleotide"
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacatgcagtggagcagcctgaaggcctcggacaccgccatgtattactgtgcgagatcgttccgggacgacccccgtatagcagtggctggcccggctgatgcttttgatatctggggccaagggacaatggtcaccgtctcttcag

SEQ ID NO: 3436 - DNA, 1035 bp, Artificial Sequence
  source: /note="Description of Artificial Sequence: Synthetic polynucleotide"
  modified_base (1)..(11): a, c, t, g, unknown or other
  modified_base (19)..(19): a, c, t, g, unknown or other
  modified_base (685)..(685): a, c, t, g, unknown or other
  modified_base (874)..(874): a, c, t, g, unknown or other
  modified_base (879)..(879): a, c, t, g, unknown or other
  modified_base (883)..(883): a, c, t, g, unknown or other
  modified_base (941)..(941): a, c, t, g, unknown or other
  modified_base (943)..(944): a, c, t, g, unknown or other
  modified_base (951)..(951): a, c, t, g, unknown or other
  modified_base (965)..(968): a, c, t, g, unknown or other
  modified_base (984)..(984): a, c, t, g, unknown or other
  modified_base (992)..(992): a, c, t, g, unknown or other
  modified_base (996)..(996): a, c, t, g, unknown or other
  modified_base (1000)..(1004): a, c, t, g, unknown or other
  modified_base (1007)..(1011): a, c, t, g, unknown or other
  modified_base (1015)..(1016): a, c, t, g, unknown or other
  modified_base (1019)..(1019): a, c, t, g, unknown or other
  modified_base (1022)..(1023): a, c, t, g, unknown or other
  modified_base (1027)..(1035): a, c, t, g, unknown or other
nnnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccagtcagagtattagttactggttggcctggtatcagcagaaaccagggaaagcccctaagctcctgatctatcaggcgtctagtttagaaagtggggtcccgtcaaggttcagcggcagtgagtctgggacagaattcactctcaccatcagcagcctgcagcctgatgattttgcaacttattactgccaacagtataatagttacccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttatnatggntacnaataaagcaatagcatcacaaatttcacaaataaagcatttttttcactgcattctantnntggtttntccaaactcatcannnntcttatcatgtctggntcgggaantaantcgnnnnnagnnnnntggnntgnaannaacnnnnnnnnn

SEQ ID NO: 3437 - DNA, 322 bp, Artificial Sequence; identical to SEQ ID NO: 254
  source: /note="Description of Artificial Sequence: Synthetic polynucleotide"

SEQ ID NO: 3438 - DNA, 1165 bp, Artificial Sequence
  source: /note="Description of Artificial Sequence: Synthetic polynucleotide"
  modified_base (1)..(15): a, c, t, g, unknown or other
  modified_base (23)..(24): a, c, t, g, unknown or other
  modified_base (754)..(754): a, c, t, g, unknown or other
  modified_base (935)..(935): a, c, t, g, unknown or other
  modified_base (974)..(974): a, c, t, g, unknown or other
  modified_base (987)..(987): a, c, t, g, unknown or other
  modified_base (989)..(989): a, c, t, g, unknown or other
  modified_base (1002)..(1002): a, c, t, g, unknown or other
  modified_base (1004)..(1004): a, c, t, g, unknown or other
  modified_base (1012)..(1012): a, c, t, g, unknown or other
  modified_base (1015)..(1016): a, c, t, g, unknown or other
  modified_base (1018)..(1019): a, c, t, g, unknown or other
  modified_base (1024)..(1024): a, c, t, g, unknown or other
  modified_base (1034)..(1034): a, c, t, g, unknown or other
  modified_base (1040)..(1040): a, c, t, g, unknown or other
  modified_base (1049)..(1049): a, c, t, g, unknown or other
  modified_base (1051)..(1051): a, c, t, g, unknown or other
  modified_base (1054)..(1056): a, c, t, g, unknown or other
  modified_base (1058)..(1059): a, c, t, g, unknown or other
  modified_base (1062)..(1063): a, c, t, g, unknown or other
  modified_base (1065)..(1065): a, c, t, g, unknown or other
  modified_base (1067)..(1071): a, c, t, g, unknown or other
  modified_base (1079)..(1082): a, c, t, g, unknown or other
  modified_base (1084)..(1084): a, c, t, g, unknown or other
  modified_base (1086)..(1087): a, c, t, g, unknown or other
  modified_base (1092)..(1094): a, c, t, g, unknown or other
  modified_base (1098)..(1098): a, c, t, g, unknown or other
  modified_base (1101)..(1102): a, c, t, g, unknown or other
  modified_base (1111)..(1111): a, c, t, g, unknown or other
  modified_base (1118)..(1118): a, c, t, g, unknown or other
  modified_base (1120)..(1124): a, c, t, g, unknown or other
  modified_base (1126)..(1127): a, c, t, g, unknown or other
  modified_base (1131)..(1131): a, c, t, g, unknown or other
  modified_base (1134)..(1135): a, c, t, g, unknown or other
  modified_base (1140)..(1141): a, c, t, g, unknown or other
  modified_base (1144)..(1146): a, c, t, g, unknown or other
  modified_base (1150)..(1153): a, c, t, g, unknown or other
  modified_base (1156)..(1157): a, c, t, g, unknown or other
  modified_base (1159)..(1162): a, c, t, g, unknown or other
  modified_base (1164)..(1165): a, c, t, g, unknown or other
nnnnnnnnnnnnnnntatgtatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccagctgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagtagaagactggggatattgtagtagtaccaactgctattctggtgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaaaggtggacaagagagttgagcccaaatcttgtgacaaaactcacacatgcccaccgtgcccagcacctgaactcctggggggancgtcagtcttcctcttccccccaaaacccaaggacaccntcatgatctcccngnacccctgaggtcncntgcgtggnggnngnngtganccacgaagancctgangtcaagttnantgnnncnnggnngncnnnnngtgcatannnnanannaagcnnnggangannagtacaacngcacgtncnnnnngnnagcntcnncaccnnccnnnaccnnnnacnngnnnnann

SEQ ID NO: 3439 - DNA, 382 bp, Artificial Sequence
  source: /note="Description of Artificial Sequence: Synthetic polynucleotide"
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagtagaagactggggatattgtagtagtaccaactgctattctggtgcttttgatatctggggccaagggacaatggtcaccgtctcttcag

SEQ ID NO: 3440 - DNA, 997 bp, Artificial Sequence
  source: /note="Description of Artificial Sequence: Synthetic polynucleotide"
  modified_base (1)..(11): a, c, t, g, unknown or other
  modified_base (15)..(15): a, c, t, g, unknown or other
  modified_base (19)..(19): a, c, t, g, unknown or other
  modified_base (810)..(811): a, c, t, g, unknown or other
  modified_base (822)..(822): a, c, t, g, unknown or other
  modified_base (927)..(927): a, c, t, g, unknown or other
  modified_base (947)..(947): a, c, t, g, unknown or other
  modified_base (951)..(951): a, c, t, g, unknown or other
  modified_base (955)..(956): a, c, t, g, unknown or other
  modified_base (962)..(962): a, c, t, g, unknown or other
  modified_base (973)..(973): a, c, t, g, unknown or other
  modified_base (978)..(979): a, c, t, g, unknown or other
  modified_base (989)..(989): a, c, t, g, unknown or other
  modified_base (997)..(997): a, c, t, g, unknown or other
nnnnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgacgcagccaccctcggtgtctgaagcccccaggcagagggtcaccatctcctgttctggaagcagctccaacatcggaaataatgctgtaaattggtaccagcaggtcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggcgcttgggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggnnaagacagtggnccctacagaatgttcatagaagcttggccgccatggcccaacttgtttattgcagcttataatggttacaaataaagcaatagcatcacaaatttcacaaataancattttttcactgcatctanttgngttnntccaanctcatcaatgnatctnncatgtctggntcgggaan

SEQ ID NO: 3441 - DNA, 334 bp, Artificial Sequence
  source: /note="Description of Artificial Sequence: Synthetic polynucleotide"
cagtctgtgctgactcagccaccctcggtgtctgaagcccccaggcagagggtcaccatctcctgttctggaagcagctccaacatcggaaataatgctgtaaattggtaccagcaggtcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggcgcttgggtgttcggcggagggaccaagctgaccgtcctag

SEQ ID NO: 3442 - DNA, 1173 bp, Artificial Sequence
  source: /note="Description of Artificial Sequence: Synthetic polynucleotide"
  modified_base (1)..(11): a, c, t, g, unknown or other
  modified_base (16)..(16): a, c, t, g, unknown or other
  modified_base (20)..(20): a, c, t, g, unknown or other
  modified_base (988)..(988): a, c, t, g, unknown or other
  modified_base (991)..(991): a, c, t, g, unknown or other
  modified_base (994)..(994): a, c, t, g, unknown or other
  modified_base (1008)..(1008): a, c, t, g, unknown or other
  modified_base (1016)..(1017): a, c, t, g, unknown or other
  modified_base (1025)..(1025): a, c, t, g, unknown or other
  modified_base (1030)..(1030): a, c, t, g, unknown or other
  modified_base (1033)..(1034): a, c, t, g, unknown or other
  modified_base (1037)..(1038): a, c, t, g, unknown or other
  modified_base (1044)..(1047): a, c, t, g, unknown or other
  modified_base (1053)..(1053): a, c, t, g, unknown or other
  modified_base (1057)..(1058): a, c, t, g, unknown or other
  modified_base (1060)..(1060): a, c, t, g, unknown or other
  modified_base (1063)..(1063): a, c, t, g, unknown or other
  modified_base (1069)..(1071): a, c, t, g, unknown or other
  modified_base (1079)..(1079): a, c, t, g, unknown or other
  modified_base (1085)..(1085): a, c, t, g, unknown or other
  modified_base (1087)..(1087): a, c, t, g, unknown or other
  modified_base (1098)..(1099): a, c, t, g, unknown or other
  modified_base (1101)..(1104): a, c, t, g, unknown or other
  modified_base (1111)..(1111): a, c, t, g, unknown or other
  modified_base (1113)..(1113): a, c, t, g, unknown or other
  modified_base (1118)..(1118): a, c, t, g, unknown or other
  modified_base (1124)..(1125): a, c, t, g, unknown or other
  modified_base (1131)..(1133): a, c, t, g, unknown or other
  modified_base (1135)..(1135): a, c, t, g, unknown or other
  modified_base (1138)..(1139): a, c, t, g, unknown or other
  modified_base (1142)..(1142): a, c, t, g, unknown or other
  modified_base (1144)..(1144): a, c, t, g, unknown or other
  modified_base (1147)..(1148): a, c, t, g, unknown or other
  modified_base (1150)..(1152): a, c, t, g, unknown or other
  modified_base (1154)..(1155): a, c, t, g, unknown or other
  modified_base (1157)..(1161): a, c, t, g, unknown or other
  modified_base (1163)..(1166): a, c, t, g, unknown or other
  modified_base (1168)..(1173): a, c, t, g, unknown or other
nnnnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtagccatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagaggattactatgatagtagtggttcttttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggttacatgcgtggnggnggncgtgagccacgaanaccctganncagttcanctggnacnnggnnggcgtnnnntgcatnatgnnanaanaagccnnngggaggancagtananagcacgtaccnngnnnnagcgtcncncgtcngcacannactggnnnanggnnagnantannannncnngnnnnncnnnnannnnnn

SEQ ID NO: 3443 - DNA, 364 bp, Artificial Sequence; identical to SEQ ID NO: 255
  source: /note="Description of Artificial Sequence: Synthetic polynucleotide"

SEQ ID NO: 3444 - DNA, 1163 bp, Artificial Sequence
  source: /note="Description of Artificial Sequence: Synthetic polynucleotide"
  modified_base (1)..(15): a, c, t, g, unknown or other
  modified_base (18)..(19): a, c, t, g, unknown or other
  modified_base (22)..(22): a, c, t, g, unknown or other
  modified_base (886)..(886): a, c, t, g, unknown or other
  modified_base (948)..(948): a, c, t, g, unknown or other
  modified_base (1004)..(1004): a, c, t, g, unknown or other
  modified_base (1006)..(1008): a, c, t, g, unknown or other
  modified_base (1012)..(1012): a, c, t, g, unknown or other
  modified_base (1020)..(1022): a, c, t, g, unknown or other
  modified_base (1027)..(1027): a, c, t, g, unknown or other
  modified_base (1035)..(1035): a, c, t, g, unknown or other
  modified_base (1041)..(1042): a, c, t, g, unknown or other
  modified_base (1047)..(1050): a, c, t, g, unknown or other
  modified_base (1052)..(1052): a, c, t, g, unknown or other
  modified_base (1059)..(1059): a, c, t, g, unknown or other
  modified_base (1063)..(1065): a, c, t, g, unknown or other
  modified_base (1067)..(1072): a, c, t, g, unknown or other
  modified_base (1076)..(1083): a, c, t, g, unknown or other
  modified_base (1088)..(1088): a, c, t, g, unknown or other
  modified_base (1090)..(1090): a, c, t, g, unknown or other
  modified_base (1093)..(1097): a, c, t, g, unknown or other
  modified_base (1099)..(1099): a, c, t, g, unknown or other
  modified_base (1101)..(1101): a, c, t, g, unknown or other
  modified_base (1107)..(1108): a, c, t, g, unknown or other
  modified_base (1110)..(1111): a, c, t, g, unknown or other
  modified_base (1115)..(1117): a, c, t, g, unknown or other
  modified_base (1123)..(1123): a, c, t, g, unknown or other
  modified_base (1125)..(1129): a, c, t, g, unknown or other
  modified_base (1131)..(1131): a, c, t, g, unknown or other
  modified_base (1138)..(1138): a, c, t, g, unknown or other
  modified_base (1146)..(1150): a, c, t, g, unknown or other
  modified_base (1153)..(1153): a, c, t, g, unknown or other
  modified_base (1156)..(1157): a, c, t, g, unknown or other
  modified_base (1159)..(1163): a, c, t, g, unknown or other
nnnnnnnnnnnnnnntgnntcnacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctggcccagtctgccctgactcagcctgcctccgtgtctgggtctcctggacagtcgatcaccatctcctgcaccggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggntacaaataaagcaatagcatcacaaatttcacaaataaagcatttttttcactgcattctanttgtggtttgtccaaactcatcaatgtatcttatcatgtctggatcgggaattaantnnngcancaccatgnnntgaantaacctcngaagannacttnnnngnaccttcngagnnnannnnnnctgnnnnnnnngtcantnggnnnnngnangtcccnngnncccnnnaggcanannnnncnaagcatncatctcannnnncancannannnnn

SEQ ID NO: 3445 - DNA, 331 bp, Artificial Sequence; identical to SEQ ID NO: 256
  source: /note="Description of Artificial Sequence: Synthetic polynucleotide"

SEQ ID NO: 3446 - DNA, 1199 bp, Artificial Sequence
  source: /note="Description of Artificial Sequence: Synthetic polynucleotide"
  modified_base (1)..(6): a, c, t, g, unknown or other
  modified_base (8)..(11): a, c, t, g, unknown or other
  modified_base (14)..(14): a, c, t, g, unknown or other
  modified_base (18)..(18): a, c, t, g, unknown or other
  modified_base (24)..(24): a, c, t, g, unknown or other
  modified_base (998)..(998): a, c, t, g, unknown or other
  modified_base (1001)..(1003): a, c, t, g, unknown or other
  modified_base (1010)..(1010): a, c, t, g, unknown or other
  modified_base (1024)..(1024): a, c, t, g, unknown or other
  modified_base (1042)..(1042): a, c, t, g, unknown or other
  modified_base (1047)..(1049): a, c, t, g, unknown or other
  modified_base (1053)..(1053): a, c, t, g, unknown or other
  modified_base (1055)..(1057): a, c, t, g, unknown or other
  modified_base (1064)..(1064): a, c, t, g, unknown or other
  modified_base (1066)..(1066): a, c, t, g, unknown or other
  modified_base (1068)..(1068): a, c, t, g, unknown or other
  modified_base (1076)..(1076): a, c, t, g, unknown or other
  modified_base (1086)..(1086): a, c, t, g, unknown or other
  modified_base (1089)..(1089): a, c, t, g, unknown or other
  modified_base (1100)..(1100): a, c, t, g, unknown or other
  modified_base (1102)..(1104): a, c, t, g, unknown or other
  modified_base (1112)..(1113): a, c, t, g, unknown or other
  modified_base (1115)..(1116): a, c, t, g, unknown or other
  modified_base (1118)..(1120): a, c, t, g, unknown or other
  modified_base (1123)..(1123): a, c, t, g, unknown or other
  modified_base (1129)..(1130): a, c, t, g, unknown or other
  modified_base (1132)..(1134): a, c, t, g, unknown or other
  modified_base (1139)..(1140): a, c, t, g, unknown or other
  modified_base (1142)..(1142): a, c, t, g, unknown or other
  modified_base (1144)..(1146): a, c, t, g, unknown or other
  modified_base (1148)..(1148): a, c, t, g, unknown or other
  modified_base (1150)..(1154): a, c, t, g, unknown or other
  modified_base (1156)..(1157): a, c, t, g, unknown or other
  modified_base (1159)..(1164): a, c, t, g, unknown or other
  modified_base (1166)..(1167): a, c, t, g, unknown or other
  modified_base (1169)..(1175): a, c, t, g, unknown or other
  modified_base (1178)..(1180): a, c, t, g, unknown or other
  modified_base (1182)..(1182): a, c, t, g, unknown or other
  modified_base (1186)..(1186): a, c, t, g, unknown or other
  modified_base (1188)..(1190): a, c, t, g, unknown or other
  modified_base (1195)..(1199): a, c, t, g, unknown or other
nnnnnncnnnntgnatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcgtctggattcaccttcagtaactttggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaggagtaaaccccgacgatattttgactggcgtagatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggnggnnnacgtganccacgaagaccctnaggtcaagttcaactggnacgtnnnggcntnnngtgcatnangnccaagacnaagccgcggngancagtacaacancnnntaccgtgnngnnannntcntcaccnncnnnaccannantnnntnannnnngnntnnnnnncnngnnnnnnnaannncntccnannnccatnnnnn

SEQ ID NO: 3447 - DNA, 376 bp, Artificial Sequence; identical to SEQ ID NO: 257
  source: /note="Description of Artificial Sequence: Synthetic polynucleotide"

SEQ ID NO: 3448 - DNA, 1107 bp, Artificial Sequence
  source: /note="Description of Artificial Sequence: Synthetic polynucleotide"
  modified_base (1)..(10): a, c, t, g, unknown or other
  modified_base (15)..(15): a, c, t, g, unknown or other
  modified_base (19)..(19): a, c, t, g, unknown or other
  modified_base (824)..(824): a, c, t, g, unknown or other
  modified_base (879)..(879): a, c, t, g, unknown or other
  modified_base (912)..(912): a, c, t, g, unknown or other
  modified_base (941)..(941): a, c, t, g, unknown or other
  modified_base (945)..(945): a, c, t, g, unknown or other
  modified_base (948)..(948): a, c, t, g, unknown or other
  modified_base (951)..(951): a, c, t, g, unknown or other
  modified_base (963)..(963): a, c, t, g, unknown or other
  modified_base (965)..(967): a, c, t, g, unknown or other
  modified_base (970)..(970): a, c, t, g, unknown or other
  modified_base (972)..(973): a, c, t, g, unknown or other
  modified_base (983)..(983): a, c, t, g, unknown or other
  modified_base (987)..(990): a, c, t, g, unknown or other
  modified_base (992)..(992): a, c, t, g, unknown or other
  modified_base (994)..(994): a, c, t, g, unknown or other
  modified_base (996)..(996): a, c, t, g, unknown or other
  modified_base (1002)..(1002): a, c, t, g, unknown or other
  modified_base (1004)..(1004): a, c, t, g, unknown or other
  modified_base (1007)..(1009): a, c, t, g, unknown or other
  modified_base (1013)..(1015): a, c, t, g, unknown or other
  modified_base (1017)..(1017): a, c, t, g, unknown or other
  modified_base (1027)..(1033): a, c, t, g, unknown or other
  modified_base (1037)..(1037): a, c, t, g, unknown or other
  modified_base (1042)..(1042): a, c, t, g, unknown or other
  modified_base (1046)..(1046): a, c, t, g, unknown or other
  modified_base (1048)..(1049): a, c, t, g, unknown or other
  modified_base (1051)..(1057): a, c, t, g, unknown or other
  modified_base (1063)..(1068): a, c, t, g, unknown or other
  modified_base (1072)..(1072): a, c, t, g, unknown or other
  modified_base (1074)..(1074): a, c, t, g, unknown or other
  modified_base (1078)..(1083): a, c, t, g, unknown or other
  modified_base (1086)..(1086): a, c, t, g, unknown or other
  modified_base (1091)..(1092): a, c, t, g, unknown or other
  modified_base (1094)..(1096): a, c, t, g, unknown or other
  modified_base (1101)..(1107): a, c, t, g, unknown or other
nnnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccagtcagagtatgagtagctggttggcctggtatcagcagaaaccagggaacgcccctaagctcctgatctataaggcgtctagtttagaaagtggggtcccatcaaggttcagcggcagtggatctgggacagaattcactctcaccatcagcagcctgcagcctgatgattttgcaacttattactgccaacagcataatagttccccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacagggganagtgttagaagcttggccgccatggcccaacttgtttattgcagcttataatggntacaaataaagcaatagcatcacaaatttcacnaataaagcatttttttcactgcattctanttgnggnttntccaaactcatnannnatntnncatgtctggntcgnnnnantngngcagcncntgnnngaannncnctgaagagannnnnnnactntgagngaananntnnnnnnngaatgnnnnnntcantngggnnnnnnaantcccnngnnnccccnnnnnnn

SEQ ID NO: 3449 - DNA, 322 bp, Artificial Sequence; identical to SEQ ID NO: 258
  source: /note="Description of Artificial Sequence: Synthetic polynucleotide"

SEQ ID NO: 3450 - DNA, 1181 bp, Artificial Sequence
  source: /note="Description of Artificial Sequence: Synthetic polynucleotide"
  modified_base (1)..(12): a, c, t, g, unknown or other
  modified_base (16)..(16): a, c, t, g, unknown or other
  modified_base (18)..(19): a, c, t, g, unknown or other
  modified_base (898)..(898): a, c, t, g, unknown or other
  modified_base (927)..(927): a, c, t, g, unknown or other
  modified_base (959)..(959): a, c, t, g, unknown or other
  modified_base (1010)..(1010): a, c, t, g, unknown or other
  modified_base (1014)..(1014): a, c, t, g, unknown or other
  modified_base (1017)..(1019): a, c, t, g, unknown or other
  modified_base (1021)..(1022): a, c, t, g, unknown or other
  modified_base (1026)..(1028): a, c, t, g, unknown or other
  modified_base (1030)..(1030): a, c, t, g, unknown or other
  modified_base (1045)..(1045): a, c, t, g, unknown or other
  modified_base (1047)..(1048): a, c, t, g, unknown or other
  modified_base (1054)..(1056): a, c, t, g, unknown or other
  modified_base (1060)..(1060): a, c, t, g, unknown or other
  modified_base (1063)..(1063): a, c, t, g, unknown or other
  modified_base (1066)..(1067): a, c, t, g, unknown or other
  modified_base (1069)..(1069): a, c, t, g, unknown or other
  modified_base (1071)..(1071): a, c, t, g, unknown or other
  modified_base (1077)..(1077): a, c, t, g, unknown or other
  modified_base (1083)..(1083): a, c, t, g, unknown or other
  modified_base (1085)..(1088): a, c, t, g, unknown or other
  modified_base (1097)..(1099): a, c, t, g, unknown or other
  modified_base (1101)..(1102): a, c, t, g, unknown or other
  modified_base (1104)..(1107): a, c, t, g, unknown or other
  modified_base (1109)..(1109): a, c, t, g, unknown or other
  modified_base (1111)..(1111): a, c, t, g, unknown or other
  modified_base (1115)..(1117): a, c, t, g, unknown or other
  modified_base (1119)..(1119): a, c, t, g, unknown or other
  modified_base (1121)..(1126): a, c, t, g, unknown or other
  modified_base (1129)..(1133): a, c, t, g, unknown or other
  modified_base (1136)..(1136): a, c, t, g, unknown or other
  modified_base (1139)..(1141): a, c, t, g, unknown or other
  modified_base (1144)..(1144): a, c, t, g, unknown or other
  modified_base (1146)..(1146): a, c, t, g, unknown or other
  modified_base (1148)..(1148): a, c, t, g, unknown or other
  modified_base (1151)..(1151): a, c, t, g, unknown or other
  modified_base (1153)..(1153): a, c, t, g, unknown or other
  modified_base (1156)..(1157): a, c, t, g, unknown or other
  modified_base (1159)..(1160): a, c, t, g, unknown or other
  modified_base (1162)..(1163): a, c, t, g, unknown or other
  modified_base (1166)..(1166): a, c, t, g, unknown or other
  modified_base (1168)..(1168): a, c, t, g, unknown or other
  modified_base (1173)..(1174): a, c, t, g, unknown or other
  modified_base (1176)..(1181): a, c, t, g, unknown or other
nnnnnnnnnnnntgtntnnacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctggaggagggttgatccagcctggggggtccctgaaactctcctgtgtagtctctgggttcaccgtcagtaagaactacatcagttgggtccgccaggctccaggcaaggggctggaatgggtctcagttatttttgccggtggtagtacattctacgcagactccgttaagggccgattcgccatctccagagacaactccaacaacacgctgtttcttcaaatgaacagcctgagagtcgaggacacggccatttattactgtgcgagaggggacggggagttattctttgaccaatggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggancgtcagtcttcctcttccccccaaacccnaggacaccctcatgatctcccggacccctgantcacatgcgtggtggtggacgtgagccacgaagaccctgagtcaagttcantggnacnnngnnggcnnngnggtgcataatgccanannaagccnnnggangancannananagcacntaccgngnnnnagcgtcctnnncnncnnnncngnctgnnnangnnnnnnacnnnnncanggnnncancnanccntnccnncnncnntcnanaaaannannnnnn

SEQ ID NO: 3451 - DNA, 352 bp, Artificial Sequence
  source: /note="Description of Artificial Sequence: Synthetic polynucleotide"
gaggtgcagctggtggagtctggaggagggttgatccagcctggggggtccctgaaactctcctgtgtagtctctgggttcaccgtcagtaagaactacatcagttgggtccgccaggctccaggcaaggggctggaatgggtctcagttatttttgccggtggtagtacattctacgcagactccgttaagggccgattcgccatctccagagacaactccaacaacacgctgtttcttcaaatgaacagcctgagagtcgaggacacggccatttattactgtgcgagaggggacggggagttattctttgaccaatggggccagggaaccctggtcaccgtctcctcag

SEQ ID NO: 3452 - DNA, 1022 bp, Artificial Sequence
  source: /note="Description of Artificial Sequence: Synthetic polynucleotide"
  modified_base (1)..(13): a, c, t, g, unknown or other
  modified_base (646)..(646): a, c, t, g, unknown or other
  modified_base (809)..(809): a, c, t, g, unknown or other
  modified_base (811)..(811): a, c, t, g, unknown or other
  modified_base (850)..(850): a, c, t, g, unknown or other
  modified_base (882)..(883): a, c, t, g, unknown or other
  modified_base (895)..(895): a, c, t, g, unknown or other
  modified_base (929)..(930): a, c, t, g, unknown or other
  modified_base (952)..(952): a, c, t, g, unknown or other
  modified_base (956)..(957): a, c, t, g, unknown or other
  modified_base (961)..(961): a, c, t, g, unknown or other
  modified_base (963)..(963): a, c, t, g, unknown or other
  modified_base (972)..(972): a, c, t, g, unknown or other
  modified_base (979)..(980): a, c, t, g, unknown or other
  modified_base (991)..(991): a, c, t, g, unknown or other
  modified_base (1001)..(1002): a, c, t, g, unknown or other
  modified_base (1004)..(1004): a, c, t, g, unknown or other
  modified_base (1006)..(1006): a, c, t, g, unknown or other
  modified_base (1008)..(1008): a, c, t, g, unknown or other
  modified_base (1014)..(1015): a, c, t, g, unknown or other
  modified_base (1020)..(1021): a, c, t, g, unknown or other
nnnnnnnnnnnnntatgtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccgccctcagtgtctggggccccagggcagagggtcaccatctcctgcactgggaccagttccaacatcggggcaggttatgatgtgcactggtaccagcaacttcctggaagagcccccaaagtcctcatctctggaaacaacattcggccctcagaggtccctgaccgattctctggctccaggtctggcacctcagcctccctggccatcactagtctccagcctgaggatgaggctcaatattactgtcagtcttatgacagcagtctctatgcggtgttcggcggagggaccaagctgaccgtcctacgtcagcccaaggctgccccctcggtcactctgttcccaccctcgagtgaggagcttcaagccaacaaggccacactggtgtgtctcataagtgacttctacccgggagccgtgacagtggcctgnaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtgnanaagacagtggcccctacagaatgttcatagaagcttggncgccatggcccaacttgtttattgcagcttannatggttacaaantaaagcaatagcatcacaaatttcacaaataaanncatttttttcactgcattctanttgnngttngnccaaactcntcaatgnntcttatcatgnctggatcggnnantnanttcggnncagcnnc

SEQ ID NO: 3453 - DNA, 330 bp, Artificial Sequence; identical to SEQ ID NO: 260
  source: /note="Description of Artificial Sequence: Synthetic polynucleotide"

SEQ ID NO: 3454 - DNA, 1166 bp, Artificial Sequence
  source: /note="Description of Artificial Sequence: Synthetic polynucleotide"
  modified_base (1)..(8): a, c, t, g, unknown or other
  modified_base (16)..(17): a, c, t, g, unknown or other
  modified_base (674)..(674): a, c, t, g, unknown or other
  modified_base (724)..(726): a, c, t, g, unknown or other
  modified_base (815)..(817): a, c, t, g, unknown or other
  modified_base (820)..(827): a, c, t, g, unknown or other
  modified_base (829)..(829): a, c, t, g, unknown or other
  modified_base (831)..(831): a, c, t, g, unknown or other
  modified_base (833)..(833): a, c, t, g, unknown or other
  modified_base (842)..(842): a, c, t, g, unknown or other
  modified_base (848)..(849): a, c, t, g, unknown or other
  modified_base (853)..(854): a, c, t, g, unknown or other
  modified_base (861)..(862): a, c, t, g, unknown or other
  modified_base (871)..(871): a, c, t, g, unknown or other
  modified_base (874)..(874): a, c, t, g, unknown or other
  modified_base (890)..(890): a, c, t, g, unknown or other
  modified_base (900)..(900): a, c, t, g, unknown or other
  modified_base (911)..(912): a, c, t, g, unknown or other
  modified_base (918)..(919): a, c, t, g, unknown or other
  modified_base (922)..(922): a, c, t, g, unknown or other
  modified_base (924)..(930): a, c, t, g, unknown or other
  modified_base (933)..(933): a, c, t, g, unknown or other
  modified_base (941)..(943): a, c, t, g, unknown or other
  modified_base (945)..(946): a, c, t, g, unknown or other
  modified_base (962)..(965): a, c, t, g, unknown or other
  modified_base (971)..(972): a, c, t, g, unknown or other
  modified_base (975)..(976): a, c, t, g, unknown or other
  modified_base (980)..(980): a, c, t, g, unknown or other
  modified_base (983)..(983): a, c, t, g, unknown or other
  modified_base (985)..(985): a, c, t, g, unknown or other
  modified_base (987)..(987): a, c, t, g, unknown or other
  modified_base (989)..(989): a, c, t, g, unknown or other
  modified_base (996)..(996): a, c, t, g, unknown or other
  modified_base (1003)..(1003): a, c, t, g, unknown or other
  modified_base (1006)..(1006): a, c, t, g, unknown or other
  modified_base (1008)..(1009): a, c, t, g, unknown or other
  modified_base (1011)..(1013): a, c, t, g, unknown or other
  modified_base (1016)..(1018): a, c, t, g, unknown or other
  modified_base (1020)..(1025): a, c, t, g, unknown or other
  modified_base (1027)..(1029): a, c, t, g, unknown or other
  modified_base (1031)..(1031): a, c, t, g, unknown or other
  modified_base (1034)..(1035): a, c, t, g, unknown or other
  modified_base (1037)..(1039): a, c, t, g, unknown or other
  modified_base (1041)..(1046): a, c, t, g, unknown or other
  modified_base (1048)..(1057): a, c, t, g, unknown or other
  modified_base (1059)..(1059): a, c, t, g, unknown or other
  modified_base (1062)..(1065): a, c, t, g, unknown or other
  modified_base (1068)..(1069): a, c, t, g, unknown or other
  modified_base (1072)..(1072): a, c, t, g, unknown or other
  modified_base (1074)..(1077): a, c, t, g, unknown or other
  modified_base (1080)..(1088): a, c, t, g, unknown or other
  modified_base (1090)..(1090): a, c, t, g, unknown or other
  modified_base (1093)..(1093): a, c, t, g, unknown or other
  modified_base (1095)..(1104): a, c, t, g, unknown or other
  modified_base (1108)..(1110): a, c, t, g, unknown or other
  modified_base (1112)..(1112): a, c, t, g, unknown or other
  modified_base (1114)..(1123): a, c, t, g, unknown or other
  modified_base (1125)..(1131): a, c, t, g, unknown or other
  modified_base (1133)..(1137): a, c, t, g, unknown or other
  modified_base (1139)..(1141): a, c, t, g, unknown or other
  modified_base (1143)..(1147): a, c, t, g, unknown or other
  modified_base (1149)..(1152): a, c, t, g, unknown or other
  modified_base (1158)..(1165): a, c, t, g, unknown or other
nnnnnnnntatgtatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccgggtacattctcaggtgcagctggtggagtctgggggaggcttgataaagccagggcggtccctgagactctcttgtacagcctctggattcacctttggtgattatgctatgacctggttccgccaggctccagggaaggggctggagtgggtaggtttcattagaagtaaagcttatggtgggacaacaggatacgccgcgtctgtgaaatacagatttaccatctcaagagatgattccaaaagcatcgcctatctgcaaatggacagcctgaaaaccgaggacacagccgtgtattactgtactaggtgggacgggtggagtcaacatgactattggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcannnccnnnnnnnnanananttgagcccnaatctnntgannaactcanncatgcccancgngcccagcacctgactnctggggggancgtcagtctcnntccccnnaancnnnnnnnccntcatgatnnncnnaccctgagtcacatgnnnnggtggnnganntganccncnanancctgagncagtcantgnanngnnnggnnngnnnnnncnnnangcnnannnannnnnngnnnnnnnnnntncannnngcnngtncnnnngtnnnnnnnnncngtncnnnnnnnnnntggnnnangnnnnnnnnnnannnnnnngnnnnncnnnannnnncnnnncccccnnnnnnnna

SEQ ID NO: 3455 - DNA, 361 bp, Artificial Sequence
  source: /note="Description of Artificial Sequence: Synthetic polynucleotide"
gaggtgcagctggtggagtctgggggaggcttgataaagccagggcggtccctgagactctcttgtacagcctctggattcacctttggtgattatgctatgacctggttccgccaggctccagggaaggggctggagtgggtaggtttcattagaagtaaagcttatggtgggacaacaggatacgccgcgtctgtgaaatacagatttaccatctcaagagatgattccaaaagcatcgcctatctgcaaatggacagcctgaaaaccgaggacacagccgtgtattactgtactaggtgggacgggtggagtcaacatgactattggggccagggaaccctggtcaccgtctcctcag

SEQ ID NO: 3456 - DNA, 1020 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (17)..(17): a, c, t, g, unknown or other
  modified_base (796)..(796): a, c, t, g, unknown or other
  modified_base (799)..(799): a, c, t, g, unknown or other
  modified_base (801)..(801): a, c, t, g, unknown or other
  modified_base (831)..(831): a, c, t, g, unknown or other
  modified_base (837)..(837): a, c, t, g, unknown or other
  modified_base (839)..(839): a, c, t, g, unknown or other
  modified_base (854)..(854): a, c, t, g, unknown or other
  modified_base (887)..(887): a, c, t, g, unknown or other
  modified_base (892)..(892): a, c, t, g, unknown or other
  modified_base (924)..(924): a, c, t, g, unknown or other
  modified_base (949)..(949): a, c, t, g, unknown or other
  modified_base (952)..(952): a, c, t, g, unknown or other
  modified_base (954)..(955): a, c, t, g, unknown or other
  modified_base (958)..(960): a, c, t, g, unknown or other
  modified_base (966)..(966): a, c, t, g, unknown or other
  modified_base (973)..(973): a, c, t, g, unknown or other
  modified_base (977)..(977): a, c, t, g, unknown or other
  modified_base (980)..(980): a, c, t, g, unknown or other
  modified_base (993)..(993): a, c, t, g, unknown or other
  modified_base (996)..(996): a, c, t, g, unknown or other
  modified_base (998)..(998): a, c, t, g, unknown or other
  modified_base (1003)..(1003): a, c, t, g, unknown or other
  modified_base (1008)..(1011): a, c, t, g, unknown or other
  modified_base (1015)..(1016): a, c, t, g, unknown or other
  modified_base (1019)..(1020): a, c, t, g, unknown or other
nnnnnncnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacatggggatattgtgatgactcagtctccactctccctgtccgtcacccctggagagccggcctccatctcctgcaggtctagtcagagcctcctgcatagtaatggaaacaactatttcgattggtacctgcagaagccagggcagtctccacagctcctgatctatttgggttctaatcgggcctccggggtccctgacaggttcagtggcagtggatcaggcacagattttacactgaagatcagcagagtggaggctgaggatgttggggtttattactgcatgcaagttctacaaattccgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggncntgagctcgcccgtcacaaagagcttcaacngggganantgttagaagcttggncgccatggcccaacttgtttattgcagcttatnatggntacaaataaagcaatagcatcacaaatttcanaataaagcatttttttcactgcatntantnnggnnntccaanctcatcnatgnatntatcatgtctggntcngnattanttcgnnnnagcnncann

SEQ ID NO: 3457 - DNA, 335 bp, Artificial Sequence
  source: /note="Description of Artificial Sequence: Synthetic polynucleotide"
gatattgtgatgactcagtctccactctccctgtccgtcacccctggagagccggcctccatctcctgcaggtctagtcagagcctcctgcatagtaatggaaacaactatttcgattggtacctgcagaagccagggcagtctccacagctcctgatctatttgggttctaatcgggcctccggggtccctgacaggttcagtggcagtggatcaggcacagattttacactgaagatcagcagagtggaggctgaggatgttggggtttattactgcatgcaagttctacaaattccgtacacttttggccaggggaccaagctggagatcaa

SEQ ID NO: 3458 - DNA, 1056 bp, Artificial Sequence
  source: /note="Description of Artificial Sequence: Synthetic polynucleotide"
  modified_base (1)..(10): a, c, t, g, unknown or other
  modified_base (24)..(24): a, c, t, g, unknown or other
  modified_base (721)..(721): a, c, t, g, unknown or other
  modified_base (931)..(937): a, c, t, g, unknown or other
  modified_base (974)..(979): a, c, t, g, unknown or other
  modified_base (991)..(991): a, c, t, g, unknown or other
  modified_base (993)..(993): a, c, t, g, unknown or other
  modified_base (1000)..(1000): a, c, t, g, unknown or other
  modified_base (1013)..(1013): a, c, t, g, unknown or other
  modified_base (1016)..(1018): a, c, t, g, unknown or other
  modified_base (1020)..(1021): a, c, t, g, unknown or other
  modified_base (1025)..(1026): a, c, t, g, unknown or other
  modified_base (1029)..(1031): a, c, t, g, unknown or other
  modified_base (1036)..(1037): a, c, t, g, unknown or other
  modified_base (1043)..(1043): a, c, t, g, unknown or other
  modified_base (1048)..(1049): a, c, t, g, unknown or other
  modified_base (1055)..(1056): a, c, t, g, unknown or other
nnnnnnnnnnatgtatcatacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcacctacagtacctatgctatgcactgggtccgccaggctccaggcaaggggctggagtgggtggcatttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatttctaccataactggttcgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccnnnnnnncctcatgatctcccggacccctgagtcacatgcgtgnnnnnngtgagccacganancctgagncagttcaactggnacnnngnnggcnnggnnntgcannatgccnagacnnaagccnn

SEQ ID NO: 3459 - DNA, 355 bp, Artificial Sequence; identical to SEQ ID NO: 263
  source: /note="Description of Artificial Sequence: Synthetic polynucleotide"

SEQ ID NO: 3460 - DNA, 729 bp, Artificial Sequence
  source: /note="Description of Artificial Sequence: Synthetic polynucleotide"
  modified_base (1)..(4): a, c, t, g, unknown or other
  modified_base (6)..(6): a, c, t, g, unknown or other
  modified_base (12)..(13): a, c, t, g, unknown or other
  modified_base (16)..(16): a, c, t, g, unknown or other
  modified_base (19)..(19): a, c, t, g, unknown or other
  modified_base (646)..(646): a, c, t, g, unknown or other
  modified_base (708)..(708): a, c, t, g, unknown or other
  modified_base (719)..(719): a, c, t, g, unknown or other
  modified_base (721)..(721): a, c, t, g, unknown or other
  modified_base (723)..(725): a, c, t, g, unknown or other
  modified_base (728)..(729): a, c, t, g, unknown or other
nnnncnttatgnntcnacncatacgatttaggtgacactatagaataacatccactttgcctttctctccacaggtgtccactcccaggtccaactgcacctcggttctatcgattgaattccaccatgggatggtcatgtatcatcctttttctagtagcaatgcaaccggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacaggtcctccaactctgcctccctcaccatctctggactgaagactgaggacgaggctgactactactgtcagtcttatgatagcggcaatcattgggtggtattcggcggagggaccaggctgaccgtcctaggtcagcccaaggctgccccctcggtcactctgttcccgccctcgagtgaggagcttcaagccaacaaggccacactggtgtgtctcataagtgacttctacccgggagccgtgacagtggcctgganggcagatagcagccccgtcaaggcgggagtggagaccaccacaccctccaaacaaagcaacnacaagtacgcngncnnncann

SEQ ID NO: 3461 - DNA, 337 bp, Artificial Sequence
  source: /note="Description of Artificial Sequence: Synthetic polynucleotide"
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctgtggggtccctgatcggttctctggctccatcgacaggtcctccaactctgcctccctcaccatctctggactgaagactgaggacgaggctgactactactgtcagtcttatgatagcggcaatcattgggtggtattcggcggagggaccaggctgaccgtcctag

SEQ ID NO: 3462 - DNA, 1021 bp, Artificial Sequence
  source: /note="Description of Artificial Sequence: Synthetic polynucleotide"
  modified_base (1)..(9): a, c, t, g, unknown or other
  modified_base (17)..(17): a, c, t, g, unknown or other
  modified_base (842)..(842): a, c, t, g, unknown or other
  modified_base (844)..(844): a, c, t, g, unknown or other
  modified_base (956)..(956): a, c, t, g, unknown or other
  modified_base (961)..(961): a, c, t, g, unknown or other
  modified_base (978)..(978): a, c, t, g, unknown or other
  modified_base (985)..(985): a, c, t, g, unknown or other
  modified_base (993)..(994): a, c, t, g, unknown or other
  modified_base (999)..(1000): a, c, t, g, unknown or other
  modified_base (1002)..(1003): a, c, t, g, unknown or other
  modified_base (1006)..(1006): a, c, t, g, unknown or other
  modified_base (1018)..(1019): a, c, t, g, unknown or other
nnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaatgcaaccggtgtacattctcaggtgcagctggtggagtctgggggaggcgtggtccagcctgggaggtccctgagactctcctgtgcagcctctggattcaccttcagtacctatgctatgcactgggtccgccaggctccaggcgaggggctggagtgggtggcagttatttcatatgatggaagcaatacatactacgcagactccgtgaagggccgattcaccatctccagagacaattccaagaacacgctgtatctgcaaatgaacagcctgagagctgaagacacggctgtgtattactgtgcgagagatcccatatggttcggggagttattatctcctccttttgttcactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgcccagcacctgaactcctggggggaccgtcagtcttcctcttccccccaaaacccnagganaccctcatgatctcccngaccccngagtcacnngccgnngnnggnggacgtgagccnnga

SEQ ID NO: 3463 - DNA, 382 bp, Artificial Sequence; identical to SEQ ID NO: 265
  source: /note="Description of Artificial Sequence: Synthetic polynucleotide"

SEQ ID NO: 3464 - DNA, 1110 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (17)..(17): a, c, t, g, unknown or other
  modified_base (808)..(808): a, c, t, g, unknown or other
  modified_base (813)..(814): a, c, t, g, unknown or other
  modified_base (816)..(816): a, c, t, g, unknown or other
  modified_base (818)..(818): a, c, t, g, unknown or other
  modified_base (822)..(823): a, c, t, g, unknown or other
  modified_base (830)..(830): a, c, t, g, unknown or other
  modified_base (836)..(836): a, c, t, g, unknown or other
  modified_base (841)..(843): a, c, t, g, unknown or other
  modified_base (845)..(845): a, c, t, g, unknown or other
  modified_base (851)..(851): a, c, t, g, unknown or other
  modified_base (862)..(862): a, c, t, g, unknown or other
  modified_base (868)..(868): a, c, t, g, unknown or other
  modified_base (870)..(870): a, c, t, g, unknown or other
  modified_base (887)..(887): a, c, t, g, unknown or other
  modified_base (891)..(892): a, c, t, g, unknown or other
  modified_base (910)..(910): a, c, t, g, unknown or other
  modified_base (931)..(932): a, c, t, g, unknown or other
  modified_base (942)..(945): a, c, t, g, unknown or other
  modified_base (950)..(950): a, c, t, g, unknown or other
  modified_base (952)..(952): a, c, t, g, unknown or other
  modified_base (958)..(958): a, c, t, g, unknown or other
  modified_base (962)..(962): a, c, t, g, unknown or other
  modified_base (964)..(966): a, c, t, g, unknown or other
  modified_base (971)..(971): a, c, t, g, unknown or other
  modified_base (976)..(976): a, c, t, g, unknown or other
  modified_base (978)..(978): a, c, t, g, unknown or other
  modified_base (980)..(980): a, c, t, g, unknown or other
  modified_base (985)..(985): a, c, t, g, unknown or other
  modified_base (987)..(990): a, c, t, g, unknown or other
  modified_base (992)..(993): a, c, t, g, unknown or other
  modified_base (996)..(998): a, c, t, g, unknown or other
  modified_base (1000)..(1000): a, c, t, g, unknown or other
  modified_base (1002)..(1004): a, c, t, g, unknown or other
  modified_base (1008)..(1010): a, c, t, g, unknown or other
  modified_base (1014)..(1015): a, c, t, g, unknown or other
  modified_base (1017)..(1017): a, c, t, g, unknown or other
  modified_base (1019)..(1021): a, c, t, g, unknown or other
  modified_base (1023)..(1023): a, c, t, g, unknown or other
  modified_base (1025)..(1029): a, c, t, g, unknown or other
  modified_base (1031)..(1031): a, c, t, g, unknown or other
  modified_base (1035)..(1036): a, c, t, g, unknown or other
  modified_base (1039)..(1039): a, c, t, g, unknown or other
  modified_base (1041)..(1041): a, c, t, g, unknown or other
  modified_base (1045)..(1045): a, c, t, g, unknown or other
  modified_base (1047)..(1047): a, c, t, g, unknown or other
  modified_base (1049)..(1058): a, c, t, g, unknown or other
  modified_base (1061)..(1061): a, c, t, g, unknown or other
  modified_base (1063)..(1064): a, c, t, g, unknown or other
  modified_base (1066)..(1069): a, c, t, g, unknown or other
  modified_base (1072)..(1074): a, c, t, g, unknown or other
  modified_base (1078)..(1080): a, c, t, g, unknown or other
  modified_base (1083)..(1084): a, c, t, g, unknown or other
  modified_base (1086)..(1087): a, c, t, g, unknown or other
  modified_base (1090)..(1092): a, c, t, g, unknown or other
  modified_base (1094)..(1095): a, c, t, g, unknown or other
  modified_base (1097)..(1107): a, c, t, g, unknown or other
  modified_base (1109)..(1110): a, c, t, g, unknown or other
nnnnnncnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccgccctcagtgtctgcggccccaggacagaaggtcaccatctcctgctctggaagcagctccaacattgggaataatttggtatcctggtaccagcagctcccaggaacagcccccaaactcctcatctatgaaaataataagcgaccctcagggattcctgaccgattctctggctccaagtctggcacgtcagccaccctgggcatcaccggactccagactggggacgaggccgattattactgcggagcatgggatagcagcctgagtgctggcggggtttatgtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcancgtgnnananagtnnccctacngaatgntcatnnnancttggngcatggcccanttgttnantgcagcttataatggtncaannaagcatagcatcacaaanttcacaaataagcattttttnnctgcatctannnngttgncnaactcntcangnnncttancatgncngntcggnannnngnncannncntnnngaannnaccnntnannnantnnnnngnactnngangngaanancnnnnnnnnnnggngnnannnnggnnnaagnnnccnngnnccnnngnnannnnnnnnnnngnn

SEQ ID NO: 3465 - DNA, 340 bp, Artificial Sequence; identical to SEQ ID NO: 266
  source: /note="Description of Artificial Sequence: Synthetic polynucleotide"

SEQ ID NO: 3466 - DNA, 1226 bp, Artificial Sequence
  source: /note="Description of Artificial Sequence: Synthetic polynucleotide"
  modified_base (1)..(12): a, c, t, g, unknown or other
  modified_base (15)..(15): a, c, t, g, unknown or other
  modified_base (19)..(19): a, c, t, g, unknown or other
  modified_base (993)..(994): a, c, t, g, unknown or other
  modified_base (1004)..(1004): a, c, t, g, unknown or other
  modified_base (1010)..(1011): a, c, t, g, unknown or other
  modified_base (1016)..(1016): a, c, t, g, unknown or other
  modified_base (1021)..(1021): a, c, t, g, unknown or other
  modified_base (1023)..(1023): a, c, t, g, unknown or other
  modified_base (1031)..(1031): a, c, t, g, unknown or other
  modified_base (1047)..(1047): a, c, t, g, unknown or other
  modified_base (1052)..(1054): a, c, t, g, unknown or other
  modified_base (1074)..(1074): a, c, t, g, unknown or other
  modified_base (1076)..(1076): a, c, t, g, unknown or other
  modified_base (1078)..(1079): a, c, t, g, unknown or other
  modified_base (1081)..(1082): a, c, t, g, unknown or other
  modified_base (1084)..(1084): a, c, t, g, unknown or other
  modified_base (1089)..(1089): a, c, t, g, unknown or other
  modified_base (1092)..(1092): a, c, t, g, unknown or other
  modified_base (1101)..(1101): a, c, t, g, unknown or other
  modified_base (1103)..(1103): a, c, t, g, unknown or other
  modified_base (1105)..(1108): a, c, t, g, unknown or other
  modified_base (1110)..(1114): a, c, t, g, unknown or other
  modified_base (1116)..(1117): a, c, t, g, unknown or other
  modified_base (1119)..(1123): a, c, t, g, unknown or other
  modified_base (1126)..(1126): a, c, t, g, unknown or other
  modified_base (1128)..(1129): a, c, t, g, unknown or other
  modified_base (1131)..(1131): a, c, t, g, unknown or other
  modified_base (1134)..(1135): a, c, t, g, unknown or other
  modified_base (1137)..(1142): a, c, t, g, unknown or other
  modified_base (1145)..(1150): a, c, t, g, unknown or other
  modified_base (1152)..(1164): a, c, t, g, unknown or other
  modified_base (1166)..(1166): a, c, t, g, unknown or other
  modified_base (1170)..(1170): a, c, t, g, unknown or other
  modified_base (1172)..(1175): a, c, t, g, unknown or other
  modified_base (1178)..(1181): a, c, t, g, unknown or other
  modified_base (1184)..(1185): a, c, t, g, unknown or other
  modified_base (1188)..(1189): a, c, t, g, unknown or other
  modified_base (1191)..(1191): a, c, t, g, unknown or other
  modified_base (1196)..(1198): a, c, t, g, unknown or other
  modified_base (1201)..(1201): a, c, t, g, unknown or other
  modified_base (1205)..(1208): a, c, t, g, unknown or other
  modified_base (1213)..(1214): a, c, t, g, unknown or other
  modified_base (1216)..(1216): a, c, t, g, unknown or other
  modified_base (1218)..(1221): a, c, t, g, unknown or other
  modified_base (1225)..(1226): a, c, t, g, unknown or other
nnnnnnnnnnnntgnatcnacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctatttattactgtgcgagtggatatactggctacgattattttgtgcggggggactactacggtctggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtnncatgcgtggnggtggnngtganccacnanaccctgangtcaagttcaactggnacgtnnnggcgtgaaggtgcataatgncnannannanccgcnggnaggagcagnanannnncnnnnncnngnnnnncancnncntcnncnnnnnncannnnnntnnnnnnnnnnnnnantacnannnnagnnnncannaanncntcccnnnccncatnnnnaaaanncntnnnncaann

SEQ ID NO: 3467 - DNA, 381 bp, Artificial Sequence
  source: /note="Description of Artificial Sequence: Synthetic polynucleotide"
  modified_base (173)..(173): a, c, t, g, unknown or other
caggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatatcatatgatggaagcaatanatactacgcagactccgtgaagggccgattcaccatctccagagacaattccaagaacacgctgtatctgcaaatgaacagcctgagagctgaggacacggctatttattactgtgcgagtggatatactggctacgattattttgtgcggggggactactacggtctggacgtctggggccaagggaccacggtcaccgtctcctca

SEQ ID NO: 3468 - DNA, 1210 bp, Artificial Sequence
  source: /note="Description of Artificial Sequence: Synthetic polynucleotide"
  modified_base (1)..(9): a, c, t, g, unknown or other
  modified_base (11)..(11): a, c, t, g, unknown or other
  modified_base (16)..(20): a, c, t, g, unknown or other
  modified_base (25)..(25): a, c, t, g, unknown or other
  modified_base (757)..(757): a, c, t, g, unknown or other
  modified_base (797)..(797): a, c, t, g, unknown or other
  modified_base (860)..(860): a, c, t, g, unknown or other
  modified_base (951)..(951): a, c, t, g, unknown or other
  modified_base (954)..(954): a, c, t, g, unknown or other
  modified_base (959)..(959): a, c, t, g, unknown or other
  modified_base (979)..(979): a, c, t, g, unknown or other
  modified_base (996)..(996): a, c, t, g, unknown or other
  modified_base (1004)..(1004): a, c, t, g, unknown or other
  modified_base (1012)..(1013): a, c, t, g, unknown or other
  modified_base (1017)..(1017): a, c, t, g, unknown or other
  modified_base (1020)..(1020): a, c, t, g, unknown or other
  modified_base (1024)..(1026): a, c, t, g, unknown or other
  modified_base (1035)..(1035): a, c, t, g, unknown or other
  modified_base (1039)..(1039): a, c, t, g, unknown or other
  modified_base (1042)..(1043): a, c, t, g, unknown or other
  modified_base (1046)..(1048): a, c, t, g, unknown or other
  modified_base (1051)..(1053): a, c, t, g, unknown or other
  modified_base (1068)..(1070): a, c, t, g, unknown or other
  modified_base (1072)..(1072): a, c, t, g, unknown or other
  modified_base (1076)..(1076): a, c, t, g, unknown or other
  modified_base (1079)..(1079): a, c, t, g, unknown or other
  modified_base (1082)..(1083): a, c, t, g, unknown or other
  modified_base (1086)..(1095): a, c, t, g, unknown or other
  modified_base (1098)..(1098): a, c, t, g, unknown or other
  modified_base (1100)..(1101): a, c, t, g, unknown or other
  modified_base (1103)..(1111): a, c, t, g, unknown or other
  modified_base (1115)..(1118): a, c, t, g, unknown or other
  modified_base (1122)..(1125): a, c, t, g, unknown or other
  modified_base (1128)..(1129): a, c, t, g, unknown or other
  modified_base (1131)..(1132): a, c, t, g, unknown or other
  modified_base (1148)..(1148): a, c, t, g, unknown or other
  modified_base (1150)..(1155): a, c, t, g, unknown or other
  modified_base (1157)..(1157): a, c, t, g, unknown or other
  modified_base (1159)..(1169): a, c, t, g, unknown or other
  modified_base (1172)..(1174): a, c, t, g, unknown or other
  modified_base (1176)..(1176): a, c, t, g, unknown or other
  modified_base (1180)..(1183): a, c, t, g, unknown or other
  modified_base (1185)..(1185): a, c, t, g, unknown or other
  modified_base (1187)..(1190): a, c, t, g, unknown or other
  modified_base (1193)..(1195): a, c, t, g, unknown or other
  modified_base (1197)..(1204): a, c, t, g, unknown or other
  modified_base (1207)..(1210): a, c, t, g, unknown or other
nnnnnnnnncntatgnnnnnacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctctctcccagcctgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacactgatggcagccacagcaagggggacgggatccctgatcgcttctcaggctccagctctggggctgagcgctacctcaccatctccagcctccagtctgaggatgaggctgactattactgtcagacctggggcactggcattctcgtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtgnaagtcccacagaagctacagctgccaggtcacgcatgaanggagcaccgtggagaagacagtggcccctacagaatgttcatagaagcttgggccgccatggnccaacttgtttattgcagcttataatggttacaaataaagcaatagcatcacaaatttcacaaataaagcatttttttcactgcattctanttngtggnttgtccaaactcatcaatgnatcttatcatgtctggntcgggaantaattcgnngcancancatnnntgaaatacntctnaannagnnntgnnnggtaccttctgaggnnnangaancanctnnggnnnnnnnnnncantnngnnnnnnnnncccnnnncccnnnngcnnannatgcaaagcatgcatntnnnnnncngnnnnnnnnnnnaannncncagnnnncncnnnnggnnnannnnnnnnaannnn

SEQ ID NO: 3469 - DNA, 334 bp, Artificial Sequence
  source: /note="Description of Artificial Sequence: Synthetic polynucleotide"
cagtctgtgctgactcagtcgccctctgcctctgcctccctgggagcctcggtcaagctcacctgcactctgagcagtgggcacagcagctacgccatcgcatggcatcagcagcagccagagaagggccctcggtacttgatgaagcttaacactgatggcagccacagcaagggggacgggatccctgatcgcttctcaggctccagctctggggctgagcgctacctcaccatctccagcctccagtctgaggatgaggctgactattactgtcagacctggggcactggcattctcgtattcggcggagggaccaagctgaccgtcctag

SEQ ID NO: 3470 - DNA, 1148 bp, Artificial Sequence
  source: /note="Description of Artificial Sequence: Synthetic polynucleotide"
  modified_base (1)..(16): a, c, t, g, unknown or other
  modified_base (23)..(24): a, c, t, g, unknown or other
  modified_base (28)..(28): a, c, t, g, unknown or other
  modified_base (752)..(752): a, c, t, g, unknown or other
  modified_base (848)..(848): a, c, t, g, unknown or other
  modified_base (850)..(850): a, c, t, g, unknown or other
  modified_base (955)..(955): a, c, t, g, unknown or other
  modified_base (962)..(964): a, c, t, g, unknown or other
  modified_base (1008)..(1009): a, c, t, g, unknown or other
  modified_base (1011)..(1012): a, c, t, g, unknown or other
  modified_base (1028)..(1028): a, c, t, g, unknown or other
  modified_base (1036)..(1037): a, c, t, g, unknown or other
  modified_base (1051)..(1051): a, c, t, g, unknown or other
  modified_base (1054)..(1054): a, c, t, g, unknown or other
  modified_base (1056)..(1058): a, c, t, g, unknown or other
  modified_base (1061)..(1067): a, c, t, g, unknown or other
  modified_base (1069)..(1069): a, c, t, g, unknown or other
  modified_base (1074)..(1074): a, c, t, g, unknown or other
  modified_base (1076)..(1076): a, c, t, g, unknown or other
  modified_base (1078)..(1079): a, c, t, g, unknown or other
  modified_base (1081)..(1081): a, c, t, g, unknown or other
  modified_base (1084)..(1084): a, c, t, g, unknown or other
  modified_base (1089)..(1092): a, c, t, g, unknown or other
  modified_base (1100)..(1100): a, c, t, g, unknown or other
  modified_base (1103)..(1104): a, c, t, g, unknown or other
  modified_base (1106)..(1107): a, c, t, g, unknown or other
  modified_base (1114)..(1118): a, c, t, g, unknown or other
  modified_base (1122)..(1124): a, c, t, g, unknown or other
  modified_base (1126)..(1128): a, c, t, g, unknown or other
  modified_base (1130)..(1130): a, c, t, g, unknown or other
  modified_base (1132)..(1134): a, c, t, g, unknown or other
  modified_base (1136)..(1138): a, c, t, g, unknown or other
  modified_base (1141)..(1141): a, c, t, g, unknown or other
  modified_base (1147)..(1148): a, c, t, g, unknown or other
nnnnnnnnnnnnnnnntgtatcnncacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttacagggcagagtcaccatgaccagggacacgtccacgagcacagtctacatggagctgagcagcctgagatctgaggacacggccgtgtattactgtgcgagagccaatcatgaaacaactatggacacttactactactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgcccagcacctgaactcctggggggaccgtcagtcttcctcttccccccnaaacccnnngacaccctcatgatctcccggacccctgaggtcacatgcgtggnngnngacgtgagccacgaanaccctganncaagttcaactggnacntnnnggnnnnnnngngcatnangnnanaanaagcnnnngggaggancannannaacagcnnnnnaccnnngnnngncnnncnnnccntcaccnn

SEQ ID NO: 3471 - DNA, 381 bp, Artificial Sequence
  source: /note="Description of Artificial Sequence: Synthetic polynucleotide"
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttacagggcagagtcaccatgaccagggacacgtccacgagcacagtctacatggagctgagcagcctgagatctgaggacacggccgtgtattactgtgcgagagccaatcatgaaacaactatggacacttactactactactactacatggacgtctggggcaaagggaccacggtcaccgtctcctca

SEQ ID NO: 3472 - DNA, 1020 bp, Artificial Sequence
  source: /note="Description of Artificial Sequence: Synthetic polynucleotide"
  modified_base (1)..(11): a, c, t, g, unknown or other
  modified_base (19)..(19): a, c, t, g, unknown or other
  modified_base (807)..(807): a, c, t, g, unknown or other
  modified_base (810)..(810): a, c, t, g, unknown or other
  modified_base (850)..(850): a, c, t, g, unknown or other
  modified_base (927)..(927): a, c, t, g, unknown or other
  modified_base (945)..(945): a, c, t, g, unknown or other
  modified_base (948)..(948): a, c, t, g, unknown or other
  modified_base (951)..(952): a, c, t, g, unknown or other
  modified_base (954)..(954): a, c, t, g, unknown or other
  modified_base (956)..(957): a, c, t, g, unknown or other
  modified_base (970)..(970): a, c, t, g, unknown or other
  modified_base (974)..(974): a, c, t, g, unknown or other
  modified_base (977)..(977): a, c, t, g, unknown or other
  modified_base (979)..(979): a, c, t, g, unknown or other
  modified_base (990)..(990): a, c, t, g, unknown or other
  modified_base (996)..(996): a, c, t, g, unknown or other
  modified_base (998)..(998): a, c, t, g, unknown or other
  modified_base (1000)..(1000): a, c, t, g, unknown or other
  modified_base (1002)..(1002): a, c, t, g, unknown or other
  modified_base (1006)..(1010): a, c, t, g, unknown or other
  modified_base (1015)..(1016): a, c, t, g, unknown or other
  modified_base (1019)..(1020): a, c, t, g, unknown or other
nnnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggtggttataagtatgtctcctggtaccaacggcacccaggcaaagcccccaaactcatgatatatgatgtcagtaatcggccctcaggggtttctaatcgcttctctggctccaagtctggcaacacggcctccctgaccatctctgggctccaggctgaggacgaggctgattattactgcagctcatacacaagcagcagcacttctgtggtgttcggcggagggacccagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgnggngaagacagtggcccctacagaatgttcatagaagcttggncgccatggcccaacttgtttattgcagcttataatggttacaaataaagcaatagcatcacaaatttcacaaataancatttttttcactgcatntantgnngntnntccaaactcatcnatgnatntntcatgtctggntcgggnantnantcgnnnnnagcannatnn

SEQ ID NO: 3473 - DNA, 334 bp, Artificial Sequence; identical to SEQ ID NO: 270
  source: /note="Description of Artificial Sequence: Synthetic polynucleotide"

SEQ ID NO: 3474 - DNA, 1135 bp, Artificial Sequence
  source: /note="Description of Artificial Sequence: Synthetic polynucleotide"
  modified_base (1)..(10): a, c, t, g, unknown or other
  modified_base (14)..(15): a, c, t, g, unknown or other
  modified_base (18)..(18): a, c, t, g, unknown or other
  modified_base (877)..(880): a, c, t, g, unknown or other
  modified_base (887)..(887): a, c, t, g, unknown or other
  modified_base (892)..(895): a, c, t, g, unknown or other
  modified_base (898)..(899): a, c, t, g, unknown or other
  modified_base (902)..(907): a, c, t, g, unknown or other
  modified_base (913)..(914): a, c, t, g, unknown or other
  modified_base (922)..(922): a, c, t, g, unknown or other
  modified_base (924)..(924): a, c, t, g, unknown or other
  modified_base (930)..(930): a, c, t, g, unknown or other
  modified_base (934)..(934): a, c, t, g, unknown or other
  modified_base (936)..(938): a, c, t, g, unknown or other
  modified_base (940)..(940): a, c, t, g, unknown or other
  modified_base (944)..(945): a, c, t, g, unknown or other
  modified_base (947)..(947): a, c, t, g, unknown or other
  modified_base (949)..(952): a, c, t, g, unknown or other
  modified_base (954)..(955): a, c, t, g, unknown or other
  modified_base (957)..(958): a, c, t, g, unknown or other
  modified_base (960)..(960): a, c, t, g, unknown or other
  modified_base (965)..(965): a, c, t, g, unknown or other
  modified_base (968)..(969): a, c, t, g, unknown or other
  modified_base (971)..(984): a, c, t, g, unknown or other
  modified_base (987)..(988): a, c, t, g, unknown or other
  modified_base (990)..(993): a, c, t, g, unknown or other
  modified_base (996)..(998): a, c, t, g, unknown or other
  modified_base (1000)..(1000): a, c, t, g, unknown or other
  modified_base (1003)..(1006): a, c, t, g, unknown or other
  modified_base (1008)..(1011): a, c, t, g, unknown or other
  modified_base (1013)..(1020): a, c, t, g, unknown or other
  modified_base (1022)..(1034): a, c, t, g, unknown or other
  modified_base (1036)..(1036): a, c, t, g, unknown or other
  modified_base (1040)..(1041): a, c, t, g, unknown or other
  modified_base (1043)..(1046): a, c, t, g, unknown or other
  modified_base (1048)..(1050): a, c, t, g, unknown or other
  modified_base (1053)..(1055): a, c, t, g, unknown or other
  modified_base (1057)..(1060): a, c, t, g, unknown or other
  modified_base (1062)..(1069): a, c, t, g, unknown or other
  modified_base (1071)..(1073): a, c, t, g, unknown or other
  modified_base (1075)..(1082): a, c, t, g, unknown or other
  modified_base (1084)..(1091): a, c, t, g, unknown or other
  modified_base (1093)..(1094): a, c, t, g, unknown or other
  modified_base (1097)..(1102): a, c, t, g, unknown or other
  modified_base (1104)..(1105): a, c, t, g, unknown or other
  modified_base (1107)..(1109): a, c, t, g, unknown or other
  modified_base (1111)..(1113): a, c, t, g, unknown or other
  modified_base (1115)..(1115): a, c, t, g, unknown or other
  modified_base (1121)..(1121): a, c, t, g, unknown or other
  modified_base (1124)..(1124): a, c, t, g, unknown or other
  modified_base (1126)..(1127): a, c, t, g, unknown or other
  modified_base (1131)..(1135): a, c, t, g, unknown or other
nnnnnnnnnnatgnntcnacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcaccgtcagtagcaactacatgacctgggtccgccaggctccagggaaggggctggagtgggtctcacttatttatcccggtggtagcacatactacgcagactccgtgaagggccgattcaccatctccagagacaattccaagaacacgctgtatcttcaaatgaacagcctgagagccgaggacacggccgtctattactgtgcgagagagggtatgggtatggcagcagctggtacgtggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgccnnnnctgaacntctgnnnnggnnggnnnnnnttcctnnttcctccntncccccnaagncnnngngaanncntnnnngnntnncncgaanccnntnnnnnnnnnnnnnnggnngnnnnacnnnanccnnnnannnncnnnnnnnnannnnnnnnnnnnngngganngnnnngnnngtnnntnnnncnnnnnnnncnnngnnnnnnnntnnnnnnnncnngtnnnnnngnnannncnnncnccgtcngcncnnactnnnnn

SEQ ID NO: 3475 - DNA, 355 bp, Artificial Sequence; identical to SEQ ID NO: 271
  source: /note="Description of Artificial Sequence: Synthetic polynucleotide"

SEQ ID NO: 3476 - DNA, 1062 bp, Artificial Sequence
  source: /note="Description of Artificial Sequence: Synthetic polynucleotide"
  modified_base (1)..(10): a, c, t, g, unknown or other
  modified_base (15)..(15): a, c, t, g, unknown or other
  modified_base (19)..(19): a, c, t, g, unknown or other
  modified_base (946)..(947): a, c, t, g, unknown or other
  modified_base (992)..(992): a, c, t, g, unknown or other
  modified_base (995)..(997): a, c, t, g, unknown or other
  modified_base (1008)..(1008): a, c, t, g, unknown or other
  modified_base (1020)..(1022): a, c, t, g, unknown or other
  modified_base (1027)..(1028): a, c, t, g, unknown or other
  modified_base (1034)..(1034): a, c, t, g, unknown or other
  modified_base (1037)..(1040): a, c, t, g, unknown or other
  modified_base (1042)..(1043): a, c, t, g, unknown or other
  modified_base (1047)..(1047): a, c, t, g, unknown or other
  modified_base (1050)..(1050): a, c, t, g, unknown or other
  modified_base (1052)..(1053): a, c, t, g, unknown or other
  modified_base (1058)..(1062): a, c, t, g, unknown or other
nnnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattgtgccatccggatgacccagtctccatcctccctgtctgcatctgtaggagacacagtcaccatcacttgccaggcgagtcaggacattagcaagtatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcagactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggcccgccatggcccaacttgtttattgcagcttataatggttacaaataaagcaatagcatcacaaatttcacaaataaagcatttttttcactgcattctagttgnngtttgtccaaactcatcaatgtatcttatcatgtctggatcgggnatnnncggcgcagcancatggcctgaannnacctnngaagangannnngnnaggnacntnntgagnnnnn

SEQ ID NO: 3477 - DNA, 322 bp, Artificial Sequence
  source: /note="Description of Artificial Sequence: Synthetic polynucleotide"
gacatccagatgacccagtctccatcctccctgtctgcatctgtaggagacacagtcaccatcacttgccaggcgagtcaggacattagcaagtatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcagactttcggcggagggaccaaggtggagatcaaac

SEQ ID NO: 3478 - DNA, 1069 bp, Artificial Sequence
  source: /note="Description of Artificial Sequence: Synthetic polynucleotide"
  modified_base (1)..(11): a, c, t, g, unknown or other
  modified_base (15)..(15): a, c, t, g, unknown or other
  modified_base (997)..(998): a, c, t, g, unknown or other
  modified_base (1010)..(1010): a, c, t, g, unknown or other
  modified_base (1013)..(1014): a, c, t, g, unknown or other
  modified_base (1030)..(1030): a, c, t, g, unknown or other
  modified_base (1054)..(1054): a, c, t, g, unknown or other
  modified_base (1058)..(1059): a, c, t, g, unknown or other
  modified_base (1061)..(1062): a, c, t, g, unknown or other
  modified_base (1066)..(1067): a, c, t, g, unknown or other
  modified_base (1069)..(1069): a, c, t, g, unknown or other
nnnnnnnnnnnatgnatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcagccctgtcagtggtggcacaaactatgcacagaagtttcagggcagggtcaccatgaccagggacacgtccatcagcacagcctacatggagctgagcaggctgagatctgacgacacggccgtgtattactgtgcgagagccccactgttccccacaggggtgctagctggggactactactactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctganncacatgcgtggnggnngacgtgagccacgaanaccctgaggtcaagttcaactggnacgnngnnggcnngn

SEQ ID NO: 3479 - DNA, 387 bp, Artificial Sequence; identical to SEQ ID NO: 273
  source: /note="Description of Artificial Sequence: Synthetic polynucleotide"

SEQ ID NO: 3480 - DNA, 1092 bp, Artificial Sequence
  source: /note="Description of Artificial Sequence: Synthetic polynucleotide"
  modified_base (1)..(10): a, c, t, g, unknown or other
  modified_base (18)..(18): a, c, t, g, unknown or other
  modified_base (946)..(946): a, c, t, g, unknown or other
  modified_base (990)..(990): a, c, t, g, unknown or other
  modified_base (1006)..(1006): a, c, t, g, unknown or other
  modified_base (1019)..(1021): a, c, t, g, unknown or other
  modified_base (1029)..(1029): a, c, t, g, unknown or other
  modified_base (1041)..(1041): a, c, t, g, unknown or other
  modified_base (1043)..(1043): a, c, t, g, unknown or other
  modified_base (1048)..(1052): a, c, t, g, unknown or other
  modified_base (1064)..(1064): a, c, t, g, unknown or other
  modified_base (1079)..(1080): a, c, t, g, unknown or other
  modified_base (1085)..(1087): a, c, t, g, unknown or other
  modified_base (1089)..(1092): a, c, t, g, unknown or other
nnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctggactccaggctgaggacgaggctgattattactgctgctcatatgcaggtagtagcactttggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctanttgtggtttgtccaaactcatcaatgtatcttatcatgtctggntcgggaattaattcgncgcagcaccatgnnntgaaatanctctgaaagagnanttggnnnnnaccttctgagcngaaagaaccatctgnnggaannngnnnn

SEQ ID NO: 3481 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctggactccaggctgaggacgaggctgattattactgctgctcatatgcaggtagtagcactttggtattcggcggagggaccaagctgaccgtcctag

SEQ ID NO: 3482 - DNA, 1070 bp, Artificial Sequence
  source: /note="Description of Artificial Sequence: Synthetic polynucleotide"
  modified_base (1)..(11): a, c, t, g, unknown or other
  modified_base (13)..(16): a, c, t, g, unknown or other
  modified_base (19)..(19): a, c, t, g, unknown or other
  modified_base (725)..(725): a, c, t, g, unknown or other
  modified_base (834)..(834): a, c, t, g, unknown or other
  modified_base (918)..(918): a, c, t, g, unknown or other
  modified_base (920)..(920): a, c, t, g, unknown or other
  modified_base (956)..(956): a, c, t, g, unknown or other
  modified_base (964)..(964): a, c, t, g, unknown or other
  modified_base (978)..(979): a, c, t, g, unknown or other
  modified_base (985)..(985): a, c, t, g, unknown or other
  modified_base (989)..(990): a, c, t, g, unknown or other
  modified_base (992)..(992): a, c, t, g, unknown or other
  modified_base (1002)..(1003): a, c, t, g, unknown or other
  modified_base (1005)..(1005): a, c, t, g, unknown or other
  modified_base (1027)..(1027): a, c, t, g, unknown or other
  modified_base (1038)..(1039): a, c, t, g, unknown or other
  modified_base (1041)..(1042): a, c, t, g, unknown or other
  modified_base (1044)..(1048): a, c, t, g, unknown or other
  modified_base (1069)..(1070): a, c, t, g, unknown or other
nnnnnnnnnnnannnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggctcaccgtcagtagcaactacatgagctgggtccgccaggctccagggaaggggctggagtgggtctcagttctttatagcggtggtagctcattctacgcagactccgtgaagggccgattcaccatctccagagacaattccaagaacacgctgtatcttcaaatgaacagcctgagagccgaagacacggccgtgtattactgtgcgagagaaagtggggatacaactatggcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccaaggtggacaaganagttgagcccaaatcttgtgacaaaactcacacatgcccaccgtgcccagcacctgaactcctggggggaccgtcagtcttccncntccccccaaaacccaaggacaccctcatgatctccnggaccccngaggtcacatgcgnnggtggntggnngngagccacgannancctgaggtcaagttcaactggnacgtggacggnngnngnnnnncataatgccaagaccaaagcnn

SEQ ID NO: 3483 - DNA, 358 bp, Artificial Sequence; identical to SEQ ID NO: 275
  source: /note="Description of Artificial Sequence: Synthetic polynucleotide"

SEQ ID NO: 3484 - DNA, 1070 bp, Artificial Sequence
  source: /note="Description of Artificial Sequence: Synthetic polynucleotide"
  modified_base (1)..(11): a, c, t, g, unknown or other
  modified_base (14)..(18): a, c, t, g, unknown or other
  modified_base (818)..(818): a, c, t, g, unknown or other
  modified_base (824)..(824): a, c, t, g, unknown or other
  modified_base (826)..(826): a, c, t, g, unknown or other
  modified_base (830)..(830): a, c, t, g, unknown or other
  modified_base (832)..(832): a, c, t, g, unknown or other
  modified_base (835)..(835): a, c, t, g, unknown or other
  modified_base (838)..(838): a, c, t, g, unknown or other
  modified_base (845)..(849): a, c, t, g, unknown or other
  modified_base (851)..(851): a, c, t, g, unknown or other
  modified_base (856)..(856): a, c, t, g, unknown or other
  modified_base (861)..(861): a, c, t, g, unknown or other
  modified_base (863)..(863): a, c, t, g, unknown or other
  modified_base (865)..(865): a, c, t, g, unknown or other
  modified_base (867)..(867): a, c, t, g, unknown or other
  modified_base (869)..(869): a, c, t, g, unknown or other
  modified_base (871)..(873): a, c, t, g, unknown or other
  modified_base (875)..(876): a, c, t, g, unknown or other
  modified_base (879)..(881): a, c, t, g, unknown or other
  modified_base (884)..(886): a, c, t, g, unknown or other
  modified_base (894)..(894): a, c, t, g, unknown or other
  modified_base (899)..(899): a, c, t, g, unknown or other
  modified_base (907)..(911): a, c, t, g, unknown or other
  modified_base (915)..(917): a, c, t, g, unknown or other
  modified_base (920)..(920): a, c, t, g, unknown or other
  modified_base (922)..(925): a, c, t, g, unknown or other
  modified_base (932)..(935): a, c, t, g, unknown or other
  modified_base (939)..(939): a, c, t, g, unknown or other
  modified_base (941)..(941): a, c, t, g, unknown or other
  modified_base (944)..(945): a, c, t, g, unknown or other
  modified_base (947)..(948): a, c, t, g, unknown or other
  modified_base (955)..(959): a, c, t, g, unknown or other
  modified_base (961)..(962): a, c, t, g, unknown or other
  modified_base (967)..(972): a, c, t, g, unknown or other
  modified_base (974)..(977): a, c, t, g, unknown or other
  modified_base (980)..(980): a, c, t, g, unknown or other
  modified_base (984)..(984): a, c, t, g, unknown or other
  modified_base (991)..(991): a, c, t, g, unknown or other
  modified_base (993)..(999): a, c, t, g, unknown or other
  modified_base (1001)..(1019): a, c, t, g, unknown or other
  modified_base (1025)..(1027): a, c, t, g, unknown or other
  modified_base (1029)..(1032): a, c, t, g, unknown or other
  modified_base (1034)..(1035): a, c, t, g, unknown or other
  modified_base (1037)..(1038): a, c, t, g, unknown or other
  modified_base (1041)..(1042): a, c, t, g, unknown or other
  modified_base (1044)..(1046): a, c, t, g, unknown or other
  modified_base (1049)..(1050): a, c, t, g, unknown or other
  modified_base (1052)..(1052): a, c, t, g, unknown or other
  modified_base (1054)..(1059): a, c, t, g, unknown or other
  modified_base (1061)..(1061): a, c, t, g, unknown or other
  modified_base (1064)..(1064): a, c, t, g, unknown or other
  modified_base (1068)..(1070): a, c, t, g, unknown or other
nnnnnnnnnnntgnnnnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagtgactcgtacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacangggganantgtnanaanctnggccgcnnnnngnccacnttgtntntngngncnnntnntannntgnnnacaaatanaacanatcatcannnnntttnnnaanannnnttttttnnnncagncnagnngnngttggtnnnnntnntcatnnnnnnannnntgnctgnatggatnannnnnnncnnnnnnnnnnnnnnnnnnnaactannntnnnnannanntanntnnntanntncnnnnnnangangaannn

SEQ ID NO: 3485 - DNA, 322 bp, Artificial Sequence; identical to SEQ ID NO: 276
  source: /note="Description of Artificial Sequence: Synthetic polynucleotide"

SEQ ID NO: 3486 - DNA, 1135 bp, Artificial Sequence
  source: /note="Description of Artificial Sequence: Synthetic polynucleotide"
  modified_base (1)..(11): a, c, t, g, unknown or other
  modified_base (14)..(18): a, c, t, g, unknown or other
  modified_base (21)..(21): a, c, t, g, unknown or other
  modified_base (25)..(26): a, c, t, g, unknown or other
  modified_base (816)..(816): a, c, t, g, unknown or other
  modified_base (867)..(867): a, c, t, g, unknown or other
  modified_base (884)..(884): a, c, t, g, unknown or other
  modified_base (896)..(899): a, c, t, g, unknown or other
  modified_base (908)..(910): a, c, t, g, unknown or other
  modified_base (913)..(915): a, c, t, g, unknown or other
  modified_base (924)..(924): a, c, t, g, unknown or other
  modified_base (927)..(929): a, c, t, g, unknown or other
  modified_base (931)..(934): a, c, t, g, unknown or other
  modified_base (937)..(937): a, c, t, g, unknown or other
  modified_base (939)..(944): a, c, t, g, unknown or other
  modified_base (948)..(948): a, c, t, g, unknown or other
  modified_base (950)..(950): a, c, t, g, unknown or other
  modified_base (952)..(953): a, c, t, g, unknown or other
  modified_base (956)..(959): a, c, t, g, unknown or other
  modified_base (961)..(961): a, c, t, g, unknown or other
  modified_base (966)..(968): a, c, t, g, unknown or other
  modified_base (970)..(970): a, c, t, g, unknown or other
  modified_base (972)..(983): a, c, t, g, unknown or other
  modified_base (985)..(985): a, c, t, g, unknown or other
  modified_base (988)..(989): a, c, t, g, unknown or other
  modified_base (995)..(996): a, c, t, g, unknown or other
  modified_base (998)..(1013): a, c, t, g, unknown or other
  modified_base (1017)..(1020): a, c, t, g, unknown or other
  modified_base (1023)..(1024): a, c, t, g, unknown or other
  modified_base (1026)..(1026): a, c, t, g, unknown or other
  modified_base (1031)..(1032): a, c, t, g, unknown or other
  modified_base (1034)..(1039): a, c, t, g, unknown or other
  modified_base (1041)..(1041): a, c, t, g, unknown or other
  modified_base (1043)..(1048): a, c, t, g, unknown or other
  modified_base (1052)..(1052): a, c, t, g, unknown or other
  modified_base (1054)..(1055): a, c, t, g, unknown or other
  modified_base (1057)..(1058): a, c, t, g, unknown or other
  modified_base (1061)..(1061): a, c, t, g, unknown or other
  modified_base (1063)..(1065): a, c, t, g, unknown or other
  modified_base (1067)..(1067): a, c, t, g, unknown or other
  modified_base (1069)..(1071): a, c, t, g, unknown or other
  modified_base (1074)..(1074): a, c, t, g, unknown or other
  modified_base (1079)..(1081): a, c, t, g, unknown or other
  modified_base (1083)..(1084): a, c, t, g, unknown or other
  modified_base (1090)..(1094): a, c, t, g, unknown or other
  modified_base (1096)..(1096): a, c, t, g, unknown or other
  modified_base (1104)..(1104): a, c, t, g, unknown or other
  modified_base (1107)..(1107): a, c, t, g, unknown or other
  modified_base (1112)..(1112): a, c, t, g, unknown or other
  modified_base (1118)..(1120): a, c, t, g, unknown or other
  modified_base (1126)..(1128): a, c, t, g, unknown or other
  modified_base (1130)..(1131): a, c, t, g, unknown or other
  modified_base (1133)..(1135): a, c, t, g, unknown or other
nnnnnnnnnnntannnnntcntacnnatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctggggtcaccgtcagtaggaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatctatctgctgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccnccgtgcccagcacctgnactcctgggggnnnntcagtcttnnnctnnnccccaaaanccnnngnnnnccncnnnnnntccncnannccnnnngncccannngngnnnnnnnnnnnngnccnngaaccnncnnnnnnnnnnnnnnnngttnnnnggnncntgganngnnnnnnangnnnnnnatgncnnannagncnnngnannncantacannngnncgtacnnnnngncagcgtcntcncgtcntgcacnnnactggnnnanngnnn

SEQ ID NO: 3487 - DNA, 349 bp, Artificial Sequence; identical to SEQ ID NO: 277
  source: /note="Description of Artificial Sequence: Synthetic polynucleotide"

SEQ ID NO: 3488 - DNA, 1067 bp, Artificial Sequence
  source: /note="Description of Artificial Sequence: Synthetic polynucleotide"
  modified_base (1)..(7): a, c, t, g, unknown or other
  modified_base (9)..(11): a, c, t, g, unknown or other
  modified_base (14)..(14): a, c, t, g, unknown or other
  modified_base (18)..(18): a, c, t, g, unknown or other
  modified_base (840)..(840): a, c, t, g, unknown or other
  modified_base (941)..(941): a, c, t, g, unknown or other
  modified_base (945)..(946): a, c, t, g, unknown or other
  modified_base (957)..(957): a, c, t, g, unknown or other
  modified_base (971)..(971): a, c, t, g, unknown or other
  modified_base (973)..(974): a, c, t, g, unknown or other
  modified_base (984)..(984): a, c, t, g, unknown or other
  modified_base (994)..(999): a, c, t, g, unknown or other
  modified_base (1005)..(1005): a, c, t, g, unknown or other
  modified_base (1007)..(1007): a, c, t, g, unknown or other
  modified_base (1009)..(1011): a, c, t, g, unknown or other
  modified_base (1016)..(1017): a, c, t, g, unknown or other
  modified_base (1020)..(1021): a, c, t, g, unknown or other
  modified_base (1026)..(1026): a, c, t, g, unknown or other
  modified_base (1029)..(1030): a, c, t, g, unknown or other
  modified_base (1034)..(1037): a, c, t, g, unknown or other
  modified_base (1050)..(1050): a, c, t, g, unknown or other
  modified_base (1054)..(1057): a, c, t, g, unknown or other
  modified_base (1061)..(1063): a, c, t, g, unknown or other
  modified_base (1066)..(1067): a, c, t, g, unknown or other
nnnnnnncnnntgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctccagccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggnccgccatggcccaacttgtttattgcagcttataatggttacaaataaagcaatagcatcacaaatttcacaaataaagcatttttttcactgcattctanttgnngtttgtccaanctcatcaatgtatntnncatgtctggntcgggaattnnnnnngcagcncntnnntgaannacnntgaanagnnttgnnnngtaccttctgagngaannnntctnnngann

SEQ ID NO: 3489 - DNA, 322 bp, Artificial Sequence; identical to SEQ ID NO: 278
  source: /note="Description of Artificial Sequence: Synthetic polynucleotide"

SEQ ID NO: 3490 - DNA, 1122 bp, Artificial Sequence
  source: /note="Description of Artificial Sequence: Synthetic polynucleotide"
  modified_base (1)..(8): a, c, t, g, unknown or other
  modified_base (16)..(17): a, c, t, g, unknown or other
  modified_base (982)..(984): a, c, t, g, unknown or other
  modified_base (1002)..(1002): a, c, t, g, unknown or other
  modified_base (1015)..(1015): a, c, t, g, unknown or other
  modified_base (1022)..(1024): a, c, t, g, unknown or other
  modified_base (1042)..(1043): a, c, t, g, unknown or other
  modified_base (1045)..(1045): a, c, t, g, unknown or other
  modified_base (1052)..(1053): a, c, t, g, unknown or other
  modified_base (1063)..(1063): a, c, t, g, unknown or other
  modified_base (1071)..(1071): a, c, t, g, unknown or other
  modified_base (1073)..(1073): a, c, t, g, unknown or other
  modified_base (1084)..(1084): a, c, t, g, unknown or other
  modified_base (1095)..(1095): a, c, t, g, unknown or other
  modified_base (1102)..(1102): a, c, t, g, unknown or other
  modified_base (1110)..(1114): a, c, t, g, unknown or other
  modified_base (1116)..(1117): a, c, t, g, unknown or other
  modified_base (1120)..(1122): a, c, t, g, unknown or other
nnnnnnnntatgtatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtacagcctggggggtccctgagactctcctgtgcagcctctggattcaccttcagtggctatagcatgaactgggtccgccaggctccagggaaggggccggagtgggtttcatacattagtaggagtagtagtaccatatactacgcagactctgtgaagggccgattcaccatctccagagacaatgccaagaactcactgtatctgcaaatgaacagcctgagagacgaggacacggctgtgtattactgtgcgagagaaggggctagagtgggagctacatatgacacgtactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgnnncacatgcgtggtggtggncgtgagccacganaccctgnnncaagttcaactggtacgnngncgggcgnngaggtgcatnatgccaananaagccgcgggnaggagcagtanaacagcncgtaccgnnnnngnnagnnn

SEQ ID NO: 3491 - DNA, 376 bp, Artificial Sequence; identical to SEQ ID NO: 279
  source: /note="Description of Artificial Sequence: Synthetic polynucleotide"

SEQ ID NO: 3492 - DNA, 1083 bp, Artificial Sequence
  source: /note="Description of Artificial Sequence: Synthetic polynucleotide"
  modified_base (1)..(11): a, c, t, g, unknown or other
  modified_base (14)..(15): a, c, t, g, unknown or other
  modified_base (18)..(18): a, c, t, g, unknown or other
  modified_base (998)..(998): a, c, t, g, unknown or other
  modified_base (1004)..(1006): a, c, t, g, unknown or other
  modified_base (1010)..(1010): a, c, t, g, unknown or other
  modified_base (1013)..(1013): a, c, t, g, unknown or other
  modified_base (1019)..(1020): a, c, t, g, unknown or other
  modified_base (1038)..(1038): a, c, t, g, unknown or other
  modified_base (1040)..(1040): a, c, t, g, unknown or other
  modified_base (1048)..(1050): a, c, t, g, unknown or other
  modified_base (1058)..(1058): a, c, t, g, unknown or other
  modified_base (1062)..(1062): a, c, t, g, unknown or other
  modified_base (1064)..(1064): a, c, t, g, unknown or other
  modified_base (1072)..(1072): a, c, t, g, unknown or other
  modified_base (1075)..(1075): a, c, t, g, unknown or other
  modified_base (1080)..(1083): a, c, t, g, unknown or other
nnnnnnnnnnntgnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacacagtctccagccaccctgtctttgtctccaggggaaagagccaccctctcctgcagggccagtcagagttttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtaacaactggcctcccgagtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggatcgggaantaattnnngcancancatggnntgaaataacctctgaaananaacttggnnnggtacctnctgnangcggaaanaancatcnnnn

SEQ ID NO: 3493 - DNA, 328 bp, Artificial Sequence; identical to SEQ ID NO: 280
  source: /note="Description of Artificial Sequence: Synthetic polynucleotide"

SEQ ID NO: 3494 - DNA, 1120 bp, Artificial Sequence
  source: /note="Description of Artificial Sequence: Synthetic polynucleotide"
  modified_base (1)..(10): a, c, t, g, unknown or other
  modified_base (832)..(833): a, c, t, g, unknown or other
  modified_base (852)..(852): a, c, t, g, unknown or other
  modified_base (860)..(860): a, c, t, g, unknown or other
  modified_base (865)..(867): a, c, t, g, unknown or other
  modified_base (872)..(872): a, c, t, g, unknown or other
  modified_base (874)..(874): a, c, t, g, unknown or other
  modified_base (877)..(877): a, c, t, g, unknown or other
  modified_base (879)..(881): a, c, t, g, unknown or other
  modified_base (883)..(885): a, c, t, g, unknown or other
  modified_base (888)..(889): a, c, t, g, unknown or other
  modified_base (891)..(892): a, c, t, g, unknown or other
  modified_base (894)..(894): a, c, t, g, unknown or other
  modified_base (899)..(899): a, c, t, g, unknown or other
  modified_base (903)..(910): a, c, t, g, unknown or other
  modified_base (919)..(925): a, c, t, g, unknown or other
  modified_base (931)..(942): a, c, t, g, unknown or other
  modified_base (955)..(955): a, c, t, g, unknown or other
  modified_base (962)..(962): a, c, t, g, unknown or other
  modified_base (971)..(975): a, c, t, g, unknown or other
  modified_base (979)..(980): a, c, t, g, unknown or other
  modified_base (983)..(983): a, c, t, g, unknown or other
  modified_base (989)..(989): a, c, t, g, unknown or other
  modified_base (992)..(993): a, c, t, g, unknown or other
  modified_base (1003)..(1004): a, c, t, g, unknown or other
  modified_base (1010)..(1010): a, c, t, g, unknown or other
  modified_base (1014)..(1015): a, c, t, g, unknown or other
  modified_base (1017)..(1017): a, c, t, g, unknown or other
  modified_base (1019)..(1021): a, c, t, g, unknown or other
  modified_base (1023)..(1025): a, c, t, g, unknown or other
  modified_base (1028)..(1028): a, c, t, g, unknown or other
  modified_base (1030)..(1030): a, c, t, g, unknown or other
  modified_base (1035)..(1037): a, c, t, g, unknown or other
  modified_base (1042)..(1043): a, c, t, g, unknown or other
  modified_base (1045)..(1047): a, c, t, g, unknown or other
  modified_base (1049)..(1052): a, c, t, g, unknown or other
  modified_base (1059)..(1059): a, c, t, g, unknown or other
  modified_base (1063)..(1063): a, c, t, g, unknown or other
  modified_base (1065)..(1067): a, c, t, g, unknown or other
  modified_base (1069)..(1069): a, c, t, g, unknown or other
  modified_base (1075)..(1075): a, c, t, g, unknown or other
  modified_base (1077)..(1078): a, c, t, g, unknown or other
  modified_base (1081)..(1081): a, c, t, g, unknown or other
  modified_base (1084)..(1084): a, c, t, g, unknown or other
  modified_base (1090)..(1090): a, c, t, g, unknown or other
  modified_base (1097)..(1097): a, c, t, g, unknown or other
  modified_base (1099)..(1100): a, c, t, g, unknown or other
  modified_base (1102)..(1102): a, c, t, g, unknown or other
  modified_base (1105)..(1107): a, c, t, g, unknown or other
  modified_base (1110)..(1110): a, c, t, g, unknown or other
  modified_base (1113)..(1115): a, c, t, g, unknown or other
  modified_base (1117)..(1117): a, c, t, g, unknown or other
  modified_base (1119)..(1120): a, c, t, g, unknown or other
nnnnnnnnnnatgtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaccttattgtagtggtggtagctgctctgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnngtggacaagagagttgagnccaaatcntgtgnnnaactnanacntnnncnnnccnncnngnccagnaccnnnnnnnncgggggggnnnnnnncatttnnnnnnnnnnnnaaacccagggacnccctcantgatctccnnnnncccnngangtcacntgnngtggtggtgnncgtganccannanannngnnncantnaactnnncgtgnngnnntnnnntgcatangcanannncncgggangnncantanacagcncgtacgngnngncannntcntcnnngncnn

SEQ ID NO: 3495 - DNA, 370 bp, Artificial Sequence
  source: /note="Description of Artificial Sequence: Synthetic polynucleotide"
caaatgcagctggtgcagtctgggcctgaggtgaagaagcctgggacctcagtgaaggtctcctgcaaggcttctggattcacctttactagctctgctgtgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaccttattgtagtggtggtagctgctctgatgcttttgatatctggggccaagggacaatggtcaccgtctcttcag

SEQ ID NO: 3496 - DNA, 1077 bp, Artificial Sequence
  source: /note="Description of Artificial Sequence: Synthetic polynucleotide"
  modified_base (1)..(8): a, c, t, g, unknown or other
  modified_base (10)..(11): a, c, t, g, unknown or other
  modified_base (14)..(14): a, c, t, g, unknown or other
  modified_base (916)..(916): a, c, t, g, unknown or other
  modified_base (944)..(944): a, c, t, g, unknown or other
  modified_base (959)..(959): a, c, t, g, unknown or other
  modified_base (975)..(975): a, c, t, g, unknown or other
  modified_base (994)..(994): a, c, t, g, unknown or other
  modified_base (996)..(996): a, c, t, g, unknown or other
  modified_base (998)..(998): a, c, t, g, unknown or other
  modified_base (1000)..(1002): a, c, t, g, unknown or other
  modified_base (1009)..(1009): a, c, t, g, unknown or other
  modified_base (1015)..(1016): a, c, t, g, unknown or other
  modified_base (1025)..(1025): a, c, t, g, unknown or other
  modified_base (1032)..(1033): a, c, t, g, unknown or other
  modified_base (1038)..(1038): a, c, t, g, unknown or other
  modified_base (1043)..(1043): a, c, t, g, unknown or other
  modified_base (1046)..(1046): a, c, t, g, unknown or other
  modified_base (1053)..(1055): a, c, t, g, unknown or other
  modified_base (1059)..(1059): a, c, t, g, unknown or other
  modified_base (1063)..(1065): a, c, t, g, unknown or other
  modified_base (1067)..(1067): a, c, t, g, unknown or other
  modified_base (1071)..(1075): a, c, t, g, unknown or other
  modified_base (1077)..(1077): a, c, t, g, unknown or other
nnnnnnnncnntangtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacnataaagcatttttttcactgcattctanttgtggtttgtccanctcatcaatgtatctnatcatgtctggatcgggantnantnnngcagcancatggnntgaaatacntctgaannagganttggntangtacctnnngagngaannnancatnnnnngn

SEQ ID NO: 3497 - DNA, 325 bp, Artificial Sequence; identical to SEQ ID NO: 232
  source: /note="Description of Artificial Sequence: Synthetic polynucleotide"

SEQ ID NO: 3498 - DNA, 1069 bp, Artificial Sequence
  source: /note="Description of Artificial Sequence: Synthetic polynucleotide"
  modified_base (1)..(11): a, c, t, g, unknown or other
  modified_base (13)..(16): a, c, t, g, unknown or other
  modified_base (23)..(23): a, c, t, g, unknown or other
  modified_base (81)..(86): a, c, t, g, unknown or other
  modified_base (725)..(726): a, c, t, g, unknown or other
  modified_base (829)..(830): a, c, t, g, unknown or other
  modified_base (877)..(877): a, c, t, g, unknown or other
  modified_base (930)..(930): a, c, t, g, unknown or other
  modified_base (932)..(933): a, c, t, g, unknown or other
  modified_base (937)..(939): a, c, t, g, unknown or other
  modified_base (943)..(944): a, c, t, g, unknown or other
  modified_base (955)..(956): a, c, t, g, unknown or other
  modified_base (958)..(958): a, c, t, g, unknown or other
  modified_base (966)..(966): a, c, t, g, unknown or other
  modified_base (973)..(977): a, c, t, g, unknown or other
  modified_base (984)..(984): a, c, t, g, unknown or other
  modified_base (986)..(987): a, c, t, g, unknown or other
  modified_base (997)..(997): a, c, t, g, unknown or other
  modified_base (999)..(999): a, c, t, g, unknown or other
  modified_base (1004)..(1005): a, c, t, g, unknown or other
  modified_base (1009)..(1009): a, c, t, g, unknown or other
  modified_base (1011)..(1011): a, c, t, g, unknown or other
  modified_base (1017)..(1017): a, c, t, g, unknown or other
  modified_base (1019)..(1019): a, c, t, g, unknown or other
  modified_base (1024)..(1025): a, c, t, g, unknown or other
  modified_base (1028)..(1029): a, c, t, g, unknown or other
  modified_base (1031)..(1031): a, c, t, g, unknown or other
  modified_base (1033)..(1033): a, c, t, g, unknown or other
  modified_base (1038)..(1038): a, c, t, g, unknown or other
  modified_base (1040)..(1040): a, c, t, g, unknown or other
  modified_base (1044)..(1048): a, c, t, g, unknown or other
  modified_base (1054)..(1054): a, c, t, g, unknown or other
  modified_base (1057)..(1062): a, c, t, g, unknown or other
  modified_base (1066)..(1069): a, c, t, g, unknown or other
nnnnnnnnnnncnnnntgtatcntacacatacgatttaggtgacactatagaataacatccactttgcctttctctccacnnnnnnccactcccaggtccaactgcacctcggttctatcgattgaattccaccatgggatggtcatgtatcatcctttttctagtagcaactgcaaccggtgtacattcccaggtgcagctgcaggagtcgggcccaggactggtgaagccttcggagaccctgtccctctcctgcgctgtctctggtggctccatcggtagttacttctggagctggatccggcagcccccagggaagggactggagtggattggatatctccattacagtgggagcaccaactacaacccctccctgaagagtcgagtcaccatatcagtagacacgtccaagaatcagttctccctgaagctgagctctgtgaccgctgcggacacggccgtgtattactgtgcgagattgcagtggctacgcggagcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccaaggtgganngagagttgagcccaaatcttgtgacaaaactcacacatgcccaccgngcccagcacctgactcctggggggaccgtcagtcttcctcttcccccaaaacncnnggannncccnnatgatctcccnnanccctgagncacatgnnnnnggtgggngnngtgagccacnanacccnngagntnagttcnanttggnncgnngnanggcgngnaggnnnnntaatgncannnnnnaagnnnn

SEQ ID NO: 3499 - DNA, 355 bp, Artificial Sequence; identical to SEQ ID NO: 283
  source: /note="Description of Artificial Sequence: Synthetic polynucleotide"

SEQ ID NO: 3500 - DNA, 1085 bp, Artificial Sequence
  source: /note="Description of Artificial Sequence: Synthetic polynucleotide"
  modified_base (1)..(12): a, c, t, g, unknown or other
  modified_base (19)..(19): a, c, t, g, unknown or other
  modified_base (792)..(792): a, c, t, g, unknown or other
  modified_base (794)..(794): a, c, t, g, unknown or other
  modified_base (951)..(952): a, c, t, g, unknown or other
  modified_base (955)..(955): a, c, t, g, unknown or other
  modified_base (975)..(976): a, c, t, g, unknown or other
  modified_base (980)..(980): a, c, t, g, unknown or other
  modified_base (1002)..(1004): a, c, t, g, unknown or other
  modified_base (1007)..(1009): a, c, t, g, unknown or other
  modified_base (1018)..(1020): a, c, t, g, unknown or other
  modified_base (1022)..(1022): a, c, t, g, unknown or other
  modified_base (1026)..(1027): a, c, t, g, unknown or other
  modified_base (1030)..(1030): a, c, t, g, unknown or other
  modified_base (1037)..(1037): a, c, t, g, unknown or other
  modified_base (1040)..(1042): a, c, t, g, unknown or other
  modified_base (1047)..(1047): a, c, t, g, unknown or other
  modified_base (1059)..(1063): a, c, t, g, unknown or other
  modified_base (1067)..(1067): a, c, t, g, unknown or other
  modified_base (1070)..(1070): a, c, t, g, unknown or other
  modified_base (1076)..(1078): a, c, t, g, unknown or other
  modified_base (1080)..(1080): a, c, t, g, unknown or other
  modified_base (1083)..(1083): a, c, t, g, unknown or other
  modified_base (1085)..(1085): a, c, t, g, unknown or other
nnnnnnnnnnnntgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatcaatgaagataaccaaagaccctctggggtccctgatcggttctctggctccatcgacagctcctccaactctgcctccctcaccatctctggactgaagactgaggacgaggctgactactactgtcagtcttatgatagcagcaatttggtattcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgnangggagcaccgtggagaagacagtggcccctacagaatgttcatagaagcttggccgccatggcccaacttgtttattgcagcttataatggttacaaataaagcaatagcatcacaaatttcacaaataagcatttttttcactgcattctagttgnnggnttgtccaaactcatcaatgnntctnatcatgtctggatcgggaattnnncgnnnagcaccatnnntnaaannacntctgaanagnnntggtnaggtaccttctnnnnnaaanaancatctnnngnaangn

SEQ ID NO: 3501 - DNA, 331 bp, Artificial Sequence; identical to SEQ ID NO: 284
  source: /note="Description of Artificial Sequence: Synthetic polynucleotide"

SEQ ID NO: 3502 - DNA, 1072 bp, Artificial Sequence
  source: /note="Description of Artificial Sequence: Synthetic polynucleotide"
  modified_base (1)..(11): a, c, t, g, unknown or other
  modified_base (16)..(16): a, c, t, g, unknown or other
  modified_base (19)..(19): a, c, t, g, unknown or other
  modified_base (744)..(744): a, c, t, g, unknown or other
  modified_base (840)..(840): a, c, t, g, unknown or other
  modified_base (853)..(853): a, c, t, g, unknown or other
  modified_base (924)..(924): a, c, t, g, unknown or other
  modified_base (946)..(946): a, c, t, g, unknown or other
  modified_base (950)..(950): a, c, t, g, unknown or other
  modified_base (956)..(956): a, c, t, g, unknown or other
  modified_base (971)..(971): a, c, t, g, unknown or other
  modified_base (976)..(977): a, c, t, g, unknown or other
  modified_base (990)..(991): a, c, t, g, unknown or other
  modified_base (994)..(994): a, c, t, g, unknown or other
  modified_base (1000)..(1004): a, c, t, g, unknown or other
  modified_base (1006)..(1007): a, c, t, g, unknown or other
  modified_base (1012)..(1012): a, c, t, g, unknown or other
  modified_base (1017)..(1017): a, c, t, g, unknown or other
  modified_base (1019)..(1019): a, c, t, g, unknown or other
  modified_base (1024)..(1024): a, c, t, g, unknown or other
  modified_base (1027)..(1028): a, c, t, g, unknown or other
  modified_base (1041)..(1041): a, c, t, g, unknown or other
  modified_base (1044)..(1044): a, c, t, g, unknown or other
  modified_base (1046)..(1048): a, c, t, g, unknown or other
  modified_base (1053)..(1057): a, c, t, g, unknown or other
  modified_base (1062)..(1063): a, c, t, g, unknown or other
  modified_base (1065)..(1066): a, c, t, g, unknown or other
  modified_base (1068)..(1068): a, c, t, g, unknown or other
  modified_base (1070)..(1070): a, c, t, g, unknown or other
  modified_base (1072)..(1072): a, c, t, g, unknown or other
nnnnnnnnnnntatgnatnatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgacggcgcacccccggaggatccaaggggtattttttttggggccgggcgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnaagtggacaaganagttgagcccaaatcttgtgacaaaactcacacatgcccaccgtgcccagcacctgaactcctggggggancgtcagtcttcctcttcccccnaaancccaangacaccctcatgatntcccnnacccctgaggtcnnatncgtggnnnnngnngtganccacnanacccnganncagttcaactggnacntnnnggcgnnnnntgcannanncnanan

SEQ ID NO: 3503 - DNA, 375 bp, Artificial Sequence; identical to SEQ ID NO: 285
  source: /note="Description of Artificial Sequence: Synthetic polynucleotide"

SEQ ID NO: 3504 - DNA, 1127 bp, Artificial Sequence
  source: /note="Description of Artificial Sequence: Synthetic polynucleotide"
  modified_base (1)..(15): a, c, t, g, unknown or other
  modified_base (946)..(946): a, c, t, g, unknown or other
  modified_base (982)..(982): a, c, t, g, unknown or other
  modified_base (1001)..(1001): a, c, t, g, unknown or other
  modified_base (1011)..(1011): a, c, t, g, unknown or other
  modified_base (1016)..(1016): a, c, t, g, unknown or other
  modified_base (1028)..(1028): a, c, t, g, unknown or other
  modified_base (1038)..(1038): a, c, t, g, unknown or other
  modified_base (1040)..(1041): a, c, t, g, unknown or other
  modified_base (1048)..(1049): a, c, t, g, unknown or other
  modified_base (1052)..(1053): a, c, t, g, unknown or other
  modified_base (1055)..(1055): a, c, t, g, unknown or other
  modified_base (1064)..(1066): a, c, t, g, unknown or other
  modified_base (1068)..(1069): a, c, t, g, unknown or other
  modified_base (1071)..(1072): a, c, t, g, unknown or other
  modified_base (1075)..(1077): a, c, t, g, unknown or other
  modified_base (1080)..(1086): a, c, t, g, unknown or other
  modified_base (1089)..(1093): a, c, t, g, unknown or other
  modified_base (1098)..(1110): a, c, t, g, unknown or other
  modified_base (1112)..(1113): a, c, t, g, unknown or other
  modified_base (1115)..(1116): a, c, t, g, unknown or other
  modified_base (1118)..(1127): a, c, t, g, unknown or other
nnnnnnnnnnnnnnntcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggcgtggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctanttgtggtttgtccaaactcatcaatgtatcttatcntgtctggatcgggaattanttcggcgcancaccntggcctgaatancctctgaaanannaacttgnntanngnaccttctgnnngnnanntannnaannnnnnnaannnnngtctnnnnnnnnnnnnngnnanntnnnnnnnnnn

SEQ ID NO: 3505 - DNA, 331 bp, Artificial Sequence; identical to SEQ ID NO: 286
  source: /note="Description of Artificial Sequence: Synthetic polynucleotide"

SEQ ID NO: 3506 - DNA, 1123 bp, Artificial Sequence
  source: /note="Description of Artificial Sequence: Synthetic polynucleotide"
  modified_base (1)..(11): a, c, t, g, unknown or other
  modified_base (20)..(20): a, c, t, g, unknown or other
  modified_base (840)..(840): a, c, t, g, unknown or other
  modified_base (915)..(915): a, c, t, g, unknown or other
  modified_base (955)..(955): a, c, t, g, unknown or other
  modified_base (957)..(957): a, c, t, g, unknown or other
  modified_base (974)..(974): a, c, t, g, unknown or other
  modified_base (976)..(977): a, c, t, g, unknown or other
  modified_base (983)..(984): a, c, t, g, unknown or other
  modified_base (1001)..(1001): a, c, t, g, unknown or other
  modified_base (1004)..(1004): a, c, t, g, unknown or other
  modified_base (1007)..(1008): a, c, t, g, unknown or other
  modified_base (1013)..(1013): a, c, t, g, unknown or other
  modified_base (1018)..(1018): a, c, t, g, unknown or other
  modified_base (1020)..(1020): a, c, t, g, unknown or other
  modified_base (1025)..(1025): a, c, t, g, unknown or other
  modified_base (1038)..(1038): a, c, t, g, unknown or other
  modified_base (1040)..(1042): a, c, t, g, unknown or other
  modified_base (1044)..(1044): a, c, t, g, unknown or other
  modified_base (1047)..(1048): a, c, t, g, unknown or other
  modified_base (1055)..(1057): a, c, t, g, unknown or other
  modified_base (1061)..(1062): a, c, t, g, unknown or other
  modified_base (1064)..(1064): a, c, t, g, unknown or other
  modified_base (1067)..(1067): a, c, t, g, unknown or other
  modified_base (1069)..(1071): a, c, t, g, unknown or other
  modified_base (1073)..(1074): a, c, t, g, unknown or other
  modified_base (1076)..(1076): a, c, t, g, unknown or other
  modified_base (1078)..(1081): a, c, t, g, unknown or other
  modified_base (1088)..(1088): a, c, t, g, unknown or other
  modified_base (1091)..(1091): a, c, t, g, unknown or other
  modified_base (1095)..(1095): a, c, t, g, unknown or other
  modified_base (1097)..(1100): a, c, t, g, unknown or other
  modified_base (1102)..(1106): a, c, t, g, unknown or other
  modified_base (1108)..(1116): a, c, t, g, unknown or other
  modified_base (1118)..(1119): a, c, t, g, unknown or other
  modified_base (1121)..(1123): a, c, t, g, unknown or other
nnnnnnnnnnntatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctgttggagtctgggggaggcttggtacagcctggggggtccctgagactctcctgtgcagcctctggattcacctttagcacctatgccatgagttgggtccgccaggctccagggaaggggctggagtgggtctcaactattactggtagtggtcgtgacacatactacgcagactccgtgaagggccggttcaccatctccagagacaattccaagaacacgctgtttctgcaactgaacagcctgagagccgaggacgcggccgtgtattcctgtgcgaaccaccctctggcatcaggcgacgactactaccactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaaggtggacaagagagttgagcccaaatcttgtgacaaaactcacacatgcccaccgtgcccagcacctgaactnctggggggaccgtcagtcttcctcttccccccaaaacccnangacaccctcatgatctncnngacccnngagtcacatgccgtggnggnggnngtganccacnangaccntgagtcagttcantnnncntgnnggcgtgnnngcannangcnannnannancnnnnggaggancantacnannnncnnnnncnnnnnnnnnanncnnn

SEQ ID NO: 3507 - DNA, 375 bp, Artificial Sequence; identical to SEQ ID NO: 287
  source: /note="Description of Artificial Sequence: Synthetic polynucleotide"

SEQ ID NO: 3508 - DNA, 1010 bp, Artificial Sequence
  source: /note="Description of Artificial Sequence: Synthetic polynucleotide"
  modified_base (1)..(8): a, c, t, g, unknown or other
  modified_base (10)..(14): a, c, t, g, unknown or other
  modified_base (20)..(20): a, c, t, g, unknown or other
  modified_base (793)..(793): a, c, t, g, unknown or other
  modified_base (831)..(831): a, c, t, g, unknown or other
  modified_base (848)..(848): a, c, t, g, unknown or other
  modified_base (870)..(870): a, c, t, g, unknown or other
  modified_base (880)..(881): a, c, t, g, unknown or other
  modified_base (947)..(947): a, c, t, g, unknown or other
  modified_base (950)..(950): a, c, t, g, unknown or other
  modified_base (953)..(953): a, c, t, g, unknown or other
  modified_base (960)..(960): a, c, t, g, unknown or other
  modified_base (971)..(975): a, c, t, g, unknown or other
  modified_base (990)..(990): a, c, t, g, unknown or other
  modified_base (1007)..(1010): a, c, t, g, unknown or other
nnnnnnnncnnnnngtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttaacagcaggcagttagcctggtaccagcagaaacctggccaggctcccaggctcctcatctatggtgcgtccagcagggccactggcatcccagagaggttcagtggcagtggatctgggacagacttcactctcaccatcagcagactggagtctgaagattttgcagtgtatcactgtcagcaatatggtagctcaagggcgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcaggncctgagctcgcccgtcacaaagagcttcaacagggganagtgttagaagcttggncgccatggcccaacttgtttantgcagcttanntggttacaaataaagcaatagcatcacaaatttcacaaataaagcatttttttcactgcattctantgnggnttgtccnaactcatcaannnnncttatcatgtctggntcgggaattaattccgnnnn

SEQ ID NO: 3509 - DNA, 328 bp, Artificial Sequence; identical to SEQ ID NO: 288
  source: /note="Description of Artificial Sequence: Synthetic polynucleotide"

SEQ ID NO: 3510 - DNA, 1138 bp, Artificial Sequence
  source: /note="Description of Artificial Sequence: Synthetic polynucleotide"
  modified_base (1)..(10): a, c, t, g, unknown or other
  modified_base (20)..(20): a, c, t, g, unknown or other
  modified_base (1000)..(1000): a, c, t, g, unknown or other
  modified_base (1003)..(1004): a, c, t, g, unknown or other
  modified_base (1020)..(1020): a, c, t, g, unknown or other
  modified_base (1022)..(1022): a, c, t, g, unknown or other
  modified_base (1044)..(1044): a, c, t, g, unknown or other
  modified_base (1048)..(1049): a, c, t, g, unknown or other
  modified_base (1051)..(1052): a, c, t, g, unknown or other
  modified_base (1058)..(1061): a, c, t, g, unknown or other
  modified_base (1067)..(1067): a, c, t, g, unknown or other
  modified_base (1069)..(1069): a, c, t, g, unknown or other
  modified_base (1074)..(1074): a, c, t, g, unknown or other
  modified_base (1083)..(1085): a, c, t, g, unknown or other
  modified_base (1090)..(1090): a, c, t, g, unknown or other
  modified_base (1092)..(1092): a, c, t, g, unknown or other
  modified_base (1094)..(1094): a, c, t, g, unknown or other
  modified_base (1106)..(1108): a, c, t, g, unknown or other
  modified_base (1114)..(1114): a, c, t, g, unknown or other
  modified_base (1116)..(1116): a, c, t, g, unknown or other
  modified_base (1119)..(1119): a, c, t, g, unknown or other
  modified_base (1124)..(1125): a, c, t, g, unknown or other
  modified_base (1128)..(1131): a, c, t, g, unknown or other
  modified_base (1135)..(1135): a, c, t, g, unknown or other
  modified_base (1137)..(1138): a, c, t, g, unknown or other
nnnnnnnnnnttatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtagctatggcatgaactgggtccgccaggctccaggcaaggggctggagtgggtggcagttatatcatatgatggaagtaatacatactatacagactccgtgaagggccgattcaccatctccagagacaattccaagaacacgctgtatctgcaaatgaacagcctgagagttgacgacacggctacatattactgtgcgaaagggccccggtttggctggagctatagaggggggtctggttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggnggnngacgtgagccacgaanancctgaggtcaagttcaactggnacgnngnnggcgtnnnntgcatnangccanacaaagccnnngggangnancagtacacagcnnntaccgngnggncagcnnccnnnnccgncnn

SEQ ID NO: 3511 - DNA, 376 bp, Artificial Sequence; identical to SEQ ID NO: 289
  source: /note="Description of Artificial Sequence: Synthetic polynucleotide"

SEQ ID NO: 3512 - DNA, 1019 bp, Artificial Sequence
  source: /note="Description of Artificial Sequence: Synthetic polynucleotide"
  modified_base (2)..(12): a, c, t, g, unknown or other
  modified_base (17)..(19): a, c, t, g, unknown or other
  modified_base (23)..(23): a, c, t, g, unknown or other
  modified_base (845)..(845): a, c, t, g, unknown or other
  modified_base (914)..(916): a, c, t, g, unknown or other
  modified_base (989)..(989): a, c, t, g, unknown or other
  modified_base (999)..(999): a, c, t, g, unknown or other
  modified_base (1001)..(1001): a, c, t, g, unknown or other
  modified_base (1012)..(1013): a, c, t, g, unknown or other
  modified_base (1017)..(1017): a, c, t, g, unknown or other
  modified_base (1019)..(1019): a, c, t, g, unknown or other
gnnnnnnnnnnnttatnnnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtgaatctgggacagattttactttcaccatcagcagcctgcagcctgaagatattgcaacatattactgtcaacagtatgataatctcccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggncgccatggcccaacttgtttattgcagcttataatggttacaaataaagcaatagcatcacaaatttcnnnaataaagcatttttttcactgcattctagttgtggtttgtccaaactcatcaatgtatcttatcatgtctggntcgggaattnantcggcgcagcnnccangn

SEQ ID NO: 3513 - DNA, 322 bp, Artificial Sequence; identical to SEQ ID NO: 290
  source: /note="Description of Artificial Sequence: Synthetic polynucleotide"

SEQ ID NO: 3514 - DNA, 1033 bp, Artificial Sequence
  source: /note="Description of Artificial Sequence: Synthetic polynucleotide"
  modified_base (1)..(15): a, c, t, g, unknown or other
  modified_base (18)..(22): a, c, t, g, unknown or other
  modified_base (80)..(80): a, c, t, g, unknown or other
  modified_base (827)..(827): a, c, t, g, unknown or other
  modified_base (835)..(835): a, c, t, g, unknown or other
  modified_base (924)..(924): a, c, t, g, unknown or other
  modified_base (940)..(940): a, c, t, g, unknown or other
  modified_base (944)..(944): a, c, t, g, unknown or other
  modified_base (949)..(949): a, c, t, g, unknown or other
  modified_base (961)..(963): a, c, t, g, unknown or other
  modified_base (972)..(972): a, c, t, g, unknown or other
  modified_base (974)..(974): a, c, t, g, unknown or other
  modified_base (976)..(977): a, c, t, g, unknown or other
  modified_base (984)..(986): a, c, t, g, unknown or other
  modified_base (990)..(993): a, c, t, g, unknown or other
  modified_base (995)..(995): a, c, t, g, unknown or other
  modified_base (1000)..(1000): a, c, t, g, unknown or other
  modified_base (1003)..(1003): a, c, t, g, unknown or other
  modified_base (1012)..(1012): a, c, t, g, unknown or other
  modified_base (1015)..(1016): a, c, t, g, unknown or other
  modified_base (1025)..(1026): a, c, t, g, unknown or other
  modified_base (1029)..(1030): a, c, t, g, unknown or other
  modified_base (1032)..(1033): a, c, t, g, unknown or other
nnnnnnnnnnnnnnntgnnnnntacacatacgatttaggtgacactatagaataacatccactttgcctttctctccacnggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtggtagcacaggctacgcacagaagttccagggcagagtcaccatgaccagggacacgtccacgagcacagtctacatggagctgagcagcctgagatctgaggacacggccgtgtattactgtgcgagatcccgaccgactcctgactggtacttcgatctctggggccgtggcaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaggtgganagagagttgagcccaaatcttgtgacaaactcacacatgcccaccgtgcccagcacctgaactcctggggggaccgtcagtcttcctcntccccccaaaacccangganacccntcatgatctccnnnaccctgagncncnntgcgtgnnngacnnnnanccacnaanaccctgagncanntcaactggnncgnngnn

SEQ ID NO: 3515 - DNA, 361 bp, Artificial Sequence
  source: /note="Description of Artificial Sequence: Synthetic polynucleotide"
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtggtagcacaggctacgcacagaagttccagggcagagtcaccatgaccagggacacgtccacgagcacagtctacatggagctgagcagcctgagatctgaggacacggccgtgtattactgtgcgagatcccgaccgactcctgactggtacttcgatctctggggccgtggcaccctggtcactgtctcctcag

SEQ ID NO: 3516 - DNA, 1014 bp, Artificial Sequence
  source: /note="Description of Artificial Sequence: Synthetic polynucleotide"
  modified_base (1)..(16): a, c, t, g, unknown or other
  modified_base (22)..(22): a, c, t, g, unknown or other
  modified_base (26)..(26): a, c, t, g, unknown or other
  modified_base (28)..(28): a, c, t, g, unknown or other
  modified_base (80)..(80): a, c, t, g, unknown or other
  modified_base (728)..(729): a, c, t, g, unknown or other
  modified_base (846)..(847): a, c, t, g, unknown or other
  modified_base (882)..(882): a, c, t, g, unknown or other
  modified_base (905)..(905): a, c, t, g, unknown or other
  modified_base (929)..(929): a, c, t, g, unknown or other
  modified_base (944)..(944): a, c, t, g, unknown or other
  modified_base (947)..(947): a, c, t, g, unknown or other
  modified_base (972)..(972): a, c, t, g, unknown or other
  modified_base (974)..(974): a, c, t, g, unknown or other
  modified_base (978)..(978): a, c, t, g, unknown or other
  modified_base (983)..(984): a, c, t, g, unknown or other
  modified_base (988)..(988): a, c, t, g, unknown or other
  modified_base (995)..(995): a, c, t, g, unknown or other
  modified_base (998)..(998): a, c, t, g, unknown or other
  modified_base (1001)..(1001): a, c, t, g, unknown or other
  modified_base (1009)..(1009): a, c, t, g, unknown or other
  modified_base (1011)..(1011): a, c, t, g, unknown or other
  modified_base (1013)..(1014): a, c, t, g, unknown or other
nnnnnnnnnnnnnnnngtatcntacncntacgatttaggtgacactatagaataacatccactttgcctttctctccacnggtgtccactcccaggtccaactgcaaccggttctgtgacctcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccgggggtggtattcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaannggagcaccgtggagaagacagtggcccctacagaatgttcatagaagcttggccgccatggcccaacttgtttattgcagcttataatggttacaaataaagcaatagcatcacaannttcacaaataaagcatttttttcactgcattctanttgtggtttgtccaactcatcangtatcttatcatgtctggatcggnattaattcggcgcancancatggcctgaaataacctctgaaanangaanttggnnaggnaccttcngangcngaaagaancntnn

SEQ ID NO: 3517 - DNA, 331 bp, Artificial Sequence
  source: /note="Description of Artificial Sequence: Synthetic polynucleotide"
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccgggggtggtattcggcggagggaccaagctgaccgtcctag

SEQ ID NO: 3518 - DNA, 1036 bp, Artificial Sequence
  source: /note="Description of Artificial Sequence: Synthetic polynucleotide"
  modified_base (1)..(13): a, c, t, g, unknown or other
  modified_base (15)..(15): a, c, t, g, unknown or other
  modified_base (18)..(19): a, c, t, g, unknown or other
  modified_base (683)..(683): a, c, t, g, unknown or other
  modified_base (904)..(904): a, c, t, g, unknown or other
  modified_base (926)..(926): a, c, t, g, unknown or other
  modified_base (940)..(940): a, c, t, g, unknown or other
  modified_base (943)..(943): a, c, t, g, unknown or other
  modified_base (948)..(949): a, c, t, g, unknown or other
  modified_base (963)..(965): a, c, t, g, unknown or other
  modified_base (970)..(970): a, c, t, g, unknown or other
  modified_base (976)..(976): a, c, t, g, unknown or other
  modified_base (987)..(987): a, c, t, g, unknown or other
  modified_base (992)..(993): a, c, t, g, unknown or other
  modified_base (998)..(998): a, c, t, g, unknown or other
  modified_base (1000)..(1001): a, c, t, g, unknown or other
  modified_base (1003)..(1003): a, c, t, g, unknown or other
  modified_base (1006)..(1008): a, c, t, g, unknown or other
  modified_base (1011)..(1011): a, c, t, g, unknown or other
  modified_base (1030)..(1032): a, c, t, g, unknown or other
  modified_base (1034)..(1034): a, c, t, g, unknown or other
  modified_base (1036)..(1036): a, c, t, g, unknown or other
nnnnnnnnnnnnngnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctgggtctgaggtgaagaagcctgggtcctcggtgaaggtctcctgcaaggcttctggaggcaccttcagcagctatgctttcagctgggtgcgacaggcccctggacaagggcttgagtggatgggaaggatcatccctatccttgctttagcaaactacgcacagaagttccagggcagagtcacgattaccgcggacaaatccacgagcacagcctacatggagctgagcagcctgagatctgaggacacggccgtgtattactgtgcgagagtcaatcaagcagtaactactcccttctccatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactnctggggggaccgtcagtcttcntcttccccccaaanccnaggannccctcatgatctcnnnacccngagtcnacatgcgtggnggtgnngtgancnncnaannnccngaggtcaagttcaactggnnncntn

SEQ ID NO: 3519 - DNA, 366 bp, Artificial Sequence; identical to SEQ ID NO: 293
  source: /note="Description of Artificial Sequence: Synthetic polynucleotide"

SEQ ID NO: 3520 - DNA, 1001 bp, Artificial Sequence
  source: /note="Description of Artificial Sequence: Synthetic polynucleotide"
  modified_base (1)..(13): a, c, t, g, unknown or other
  modified_base (15)..(22): a, c, t, g, unknown or other
  modified_base (28)..(28): a, c, t, g, unknown or other
  modified_base (821)..(821): a, c, t, g, unknown or other
  modified_base (829)..(829): a, c, t, g, unknown or other
  modified_base (942)..(942): a, c, t, g, unknown or other
  modified_base (944)..(949): a, c, t, g, unknown or other
  modified_base (951)..(951): a, c, t, g, unknown or other
  modified_base (953)..(953): a, c, t, g, unknown or other
  modified_base (969)..(971): a, c, t, g, unknown or other
  modified_base (984)..(984): a, c, t, g, unknown or other
  modified_base (987)..(987): a, c, t, g, unknown or other
  modified_base (992)..(992): a, c, t, g, unknown or other
  modified_base (999)..(999): a, c, t, g, unknown or other
  modified_base (1001)..(1001): a, c, t, g, unknown or other
nnnnnnnnnnnnnannnnnnnntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacnggggagantgttagaagcttggccgccatggcccaacttgtttattgcagcttataatggttacaaataagcaatagcatcacaaatttcacaaataaagcattttttcactgcattctantnnnnnntngnccaaactcatcaatgnnntcttatcatgtcnggntcggnaattaantn

SEQ ID NO: 3521 - DNA, 322 bp, Artificial Sequence; identical to SEQ ID NO: 294
  source: /note="Description of Artificial Sequence: Synthetic polynucleotide"

SEQ ID NO: 3522 - DNA, 1066 bp, Artificial Sequence
  source: /note="Description of Artificial Sequence: Synthetic polynucleotide"
  modified_base (1)..(13): a, c, t, g, unknown or other
  modified_base (78)..(78): a, c, t, g, unknown or other
  modified_base (942)..(942): a, c, t, g, unknown or other
  modified_base (945)..(945): a, c, t, g, unknown or other
  modified_base (968)..(968): a, c, t, g, unknown or other
  modified_base (974)..(974): a, c, t, g, unknown or other
  modified_base (982)..(982): a, c, t, g, unknown or other
  modified_base (996)..(996): a, c, t, g, unknown or other
  modified_base (999)..(999): a, c, t, g, unknown or other
  modified_base (1005)..(1005): a, c, t, g, unknown or other
  modified_base (1010)..(1010): a, c, t, g, unknown or other
  modified_base (1020)..(1022): a, c, t, g, unknown or other
  modified_base (1038)..(1038): a, c, t, g, unknown or other
  modified_base (1046)..(1046): a, c, t, g, unknown or other
  modified_base (1048)..(1048): a, c, t, g, unknown or other
  modified_base (1052)..(1052): a, c, t, g, unknown or other
  modified_base (1054)..(1058): a, c, t, g, unknown or other
  modified_base (1061)..(1062): a, c, t, g, unknown or other
  modified_base (1065)..(1066): a, c, t, g, unknown or other
nnnnnnnnnnnnntgtatcatacacatacgatttaggtgacactatagaataacatccactttgcctttctctccacnggtgtccactcccaggtccaactgcacctcggttctatcgattgaattccaccatgggatggtcatgtatcatcctttttctagtagcaactgcaaccggtgtacattcccaggtgcagctgcaggagtcgggcccaggactggtgaagccttcggggaccctgtccctcacctgcgctgtctctggtggctccatcagcagtaataactggtggagttgtgtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagggggggatacagctatgggccccgaatactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaanccnaaggacaccctcatgatctcccngacccntgaggtcnacatgcgtggtggnggncgtganccacnaagaccctgnnngtcaagttcaactggntacgtggnangggngnnnnnggnncann

SEQ ID NO: 3523 - DNA, 367 bp, Artificial Sequence; identical to SEQ ID NO: 295
  source: /note="Description of Artificial Sequence: Synthetic polynucleotide"

SEQ ID NO: 3524 - DNA, 889 bp, Artificial Sequence
  source: /note="Description of Artificial Sequence: Synthetic polynucleotide"
  modified_base (1)..(17): a, c, t, g, unknown or other
  modified_base (19)..(20): a, c, t, g, unknown or other
  modified_base (22)..(25): a, c, t, g, unknown or other
  modified_base (29)..(31): a, c, t, g, unknown or other
  modified_base (35)..(35): a, c, t, g, unknown or other
  modified_base (83)..(83): a, c, t, g, unknown or other
  modified_base (649)..(649): a, c, t, g, unknown or other
  modified_base (660)..(660): a, c, t, g, unknown or other
  modified_base (680)..(680): a, c, t, g, unknown or other
  modified_base (742)..(742): a, c, t, g, unknown or other
  modified_base (745)..(745): a, c, t, g, unknown or other
  modified_base (759)..(759): a, c, t, g, unknown or other
  modified_base (778)..(778): a, c, t, g, unknown or other
  modified_base (790)..(790): a, c, t, g, unknown or other
  modified_base (813)..(813): a, c, t, g, unknown or other
  modified_base (815)..(815): a, c, t, g, unknown or other
  modified_base (821)..(821): a, c, t, g, unknown or other
  modified_base (823)..(823): a, c, t, g, unknown or other
  modified_base (828)..(828): a, c, t, g, unknown or other
  modified_base (846)..(846): a, c, t, g, unknown or other
  modified_base (849)..(849): a, c, t, g, unknown or other
  modified_base (862)..(862): a, c, t, g, unknown or other
  modified_base (880)..(881): a, c, t, g, unknown or other
  modified_base (888)..(889): a, c, t, g, unknown or other
nnnnnnnnnnnnnnnnntnntnnnntacnnntacnatttaggtgacactatagaataacatccactttgcctttctctccccnggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcttttgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctgnaaggcagatancagccccgtcaaggcgggantggagaccaccacaccctccaaacaaagcaacaacaagtacgcgggccagcagctacctganccntgacgcctgagcantggaagtcccacagaagcntacagctgccangtcacgcatgaagggagcaccgngnagaganantggcncctacagaatgttcatanaancttggccgcccanggcccaacttgttattgnngcttatnn

SEQ ID NO: 3525 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcttttgttcggcggagggaccaagctgaccgtcctag

SEQ ID NO: 3526 - DNA, 1059 bp, Artificial Sequence
  source: /note="Description of Artificial Sequence: Synthetic polynucleotide"
  modified_base (1)..(15): a, c, t, g, unknown or other
  modified_base (17)..(18): a, c, t, g, unknown or other
  modified_base (20)..(21): a, c, t, g, unknown or other
  modified_base (79)..(79): a, c, t, g, unknown or other
  modified_base (81)..(81): a, c, t, g, unknown or other
  modified_base (835)..(835): a, c, t, g, unknown or other
  modified_base (856)..(856): a, c, t, g, unknown or other
  modified_base (942)..(943): a, c, t, g, unknown or other
  modified_base (951)..(951): a, c, t, g, unknown or other
  modified_base (955)..(955): a, c, t, g, unknown or other
  modified_base (960)..(960): a, c, t, g, unknown or other
  modified_base (972)..(972): a, c, t, g, unknown or other
  modified_base (983)..(983): a, c, t, g, unknown or other
  modified_base (987)..(987): a, c, t, g, unknown or other
  modified_base (990)..(992): a, c, t, g, unknown or other
  modified_base (996)..(996): a, c, t, g, unknown or other
  modified_base (999)..(999): a, c, t, g, unknown or other
  modified_base (1003)..(1006): a, c, t, g, unknown or other
  modified_base (1009)..(1009): a, c, t, g, unknown or other
  modified_base (1012)..(1012): a, c, t, g, unknown or other
  modified_base (1029)..(1029): a, c, t, g, unknown or other
  modified_base (1041)..(1042): a, c, t, g, unknown or other
  modified_base (1044)..(1046): a, c, t, g, unknown or other
  modified_base (1051)..(1051): a, c, t, g, unknown or other
  modified_base (1053)..(1059): a, c, t, g, unknown or other
nnnnnnnnnnnnnnngnntnntacacatacgatttaggtgacactatagaataacatccactttgcctttctctccacngntgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatattatatgatggaagcaataaatactacgcagactccgtgaagggccgattcaccatctccagagacaattccaagaacacgctgtatctgcaaatgaacagcctgagagctgaggacacggctgtgtattactgtgcgagagattcggacgtagatacatctatggttacttggttcgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaaggtggacaagagagttgancccaaatcttgtgacaaaactcacacatgcccaccgtgcccagcacctgaactcctggggggaccgtcagtcttcctcttcccccnnaaacccangganacccncatgatctcccngacccctgagncacntgnnntggnggnggannnnganccncgaagaccctggaggtnagttcaactggnncnnnggaangnnnnnnn

SEQ ID NO: 3527 - DNA, 370 bp, Artificial Sequence; identical to SEQ ID NO: 297
  source: /note="Description of Artificial Sequence: Synthetic polynucleotide"

SEQ ID NO: 3528 - DNA, 964 bp, Artificial Sequence
  source: /note="Description of Artificial Sequence: Synthetic polynucleotide"
  modified_base (2)..(13): a, c, t, g, unknown or other
  modified_base (19)..(21): a, c, t, g, unknown or other
  modified_base (23)..(23): a, c, t, g, unknown or other
  modified_base (77)..(77): a, c, t, g, unknown or other
  modified_base (688)..(688): a, c, t, g, unknown or other
  modified_base (786)..(786): a, c, t, g, unknown or other
  modified_base (853)..(853): a, c, t, g, unknown or other
  modified_base (877)..(877): a, c, t, g, unknown or other
  modified_base (930)..(933): a, c, t, g, unknown or other
  modified_base (940)..(940): a, c, t, g, unknown or other
  modified_base (948)..(949): a, c, t, g, unknown or other
  modified_base (954)..(954): a, c, t, g, unknown or other
  modified_base (964)..(964): a, c, t, g, unknown or other
gnnnnnnnnnnnngtatcnnncncatacgatttaggtgacactatagaataacatccactttgcctttctctccacnggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgagcaaagcagactacgagaaacacaaagtctacgcctgcgaagtcacccatcngggcctgagctcgcccgtcacaaagagcttcaacaggggagagtgttagaagcttggccgccatggnccaacttgtttattgcagcttatnatggttacaaataagcaatagcatcacaaatttcacaaataaagcattttttnnnnctgcatnctagttgnnggttngtccaaactn

SEQ ID NO: 3529 - DNA, 325 bp, Artificial Sequence; identical to SEQ ID NO: 298
  source: /note="Description of Artificial Sequence: Synthetic polynucleotide"

SEQ ID NO: 3530 - DNA, 1023 bp, Artificial Sequence
  source: /note="Description of Artificial Sequence: Synthetic polynucleotide"
  modified_base (1)..(8): a, c, t, g, unknown or other
  modified_base (10)..(13): a, c, t, g, unknown or other
  modified_base (20)..(20): a, c, t, g, unknown or other
  modified_base (737)..(738): a, c, t, g, unknown or other
  modified_base (833)..(833): a, c, t, g, unknown or other
  modified_base (847)..(847): a, c, t, g, unknown or other
  modified_base (908)..(908): a, c, t, g, unknown or other
  modified_base (941)..(941): a, c, t, g, unknown or other
  modified_base (945)..(945): a, c, t, g, unknown or other
  modified_base (948)..(948): a, c, t, g, unknown or other
  modified_base (953)..(953): a, c, t, g, unknown or other
  modified_base (970)..(971): a, c, t, g, unknown or other
  modified_base (977)..(977): a, c, t, g, unknown or other
  modified_base (985)..(985): a, c, t, g, unknown or other
  modified_base (991)..(991): a, c, t, g, unknown or other
  modified_base (995)..(996): a, c, t, g, unknown or other
  modified_base (1011)..(1011): a, c, t, g, unknown or other
  modified_base (1016)..(1017): a, c, t, g, unknown or other
  modified_base (1019)..(1019): a, c, t, g, unknown or other
  modified_base (1022)..(1023): a, c, t, g, unknown or other
nnnnnnnncnnnntgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctgttggagtctgggggaggcttggtacagcctggggggtccctgagactctcctgtgcagcctctggattcacctttagcaactatgccatgagctgggtccgccaggctccagggaaggggctggagtgggtctcagctattagtggtagtgatggtagcacatactacgcaggctccgtgaagggccggttcaccatctccagagacaattccaagaacacactgtatctgcaaatgaacagcctgagagccgaggacacggccgtatattactgtgcgaaagatccccttataactggacctacctatcaatactttcactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccnaaggtggacaaganagttgagcccaaatcttgtgacaaaactcacacatgcccaccgtgcccagcacctgaactnctgggggggaccgtcagtcttcctcttcccccnaaanccnagganaccctcatgatctcccnnaccccngaaggtcncatgcntggnnggtggacgtgagccncgaannanccnn

SEQ ID NO: 3531 - DNA, 370 bp, Artificial Sequence; identical to SEQ ID NO: 299
  source: /note="Description of Artificial Sequence: Synthetic polynucleotide"

SEQ ID NO: 3532 - DNA, 992 bp, Artificial Sequence
  source: /note="Description of Artificial Sequence: Synthetic polynucleotide"
  modified_base (1)..(12): a, c, t, g, unknown or other
  modified_base (856)..(856): a, c, t, g, unknown or other
  modified_base (879)..(880): a, c, t, g, unknown or other
  modified_base (921)..(921): a, c, t, g, unknown or other
  modified_base (946)..(946): a, c, t, g, unknown or other
  modified_base (952)..(952): a, c, t, g, unknown or other
  modified_base (954)..(955): a, c, t, g, unknown or other
  modified_base (959)..(959): a, c, t, g, unknown or other
  modified_base (963)..(963): a, c, t, g, unknown or other
  modified_base (968)..(968): a, c, t, g, unknown or other
  modified_base (972)..(976): a, c, t, g, unknown or other
  modified_base (978)..(979): a, c, t, g, unknown or other
  modified_base (992)..(992): a, c, t, g, unknown or other
nnnnnnnnnnnntgtatcatacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgacacagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgaatatcactgtcaggtgtgggatagtagtagtgatcgtccgggggtggttttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggnccaacttgtttattgcagcttannatggttacaaataaagcaatagcatcacaaatttcacaaanaaagcatttttttcactgcatctantgtggntnntccnaacncatcnatgnnnnntnncatgtctggatcn

SEQ ID NO: 3533 - DNA, 331 bp, Artificial Sequence
  source: /note="Description of Artificial Sequence: Synthetic polynucleotide"
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgaatatcactgtcaggtgtgggatagtagtagtgatcgtccgggggtggttttcggcggagggaccaagctgaccgtcctag

SEQ ID NO: 3534 - DNA, 1141 bp, Artificial Sequence
  source: /note="Description of Artificial Sequence: Synthetic polynucleotide"
  modified_base (1)..(11): a, c, t, g, unknown or other
  modified_base (18)..(18): a, c, t, g, unknown or other
  modified_base (724)..(724): a, c, t, g, unknown or other
  modified_base (820)..(820): a, c, t, g, unknown or other
  modified_base (834)..(834): a, c, t, g, unknown or other
  modified_base (936)..(939): a, c, t, g, unknown or other
  modified_base (944)..(944): a, c, t, g, unknown or other
  modified_base (956)..(957): a, c, t, g, unknown or other
  modified_base (966)..(967): a, c, t, g, unknown or other
  modified_base (969)..(969): a, c, t, g, unknown or other
  modified_base (974)..(976): a, c, t, g, unknown or other
  modified_base (979)..(979): a, c, t, g, unknown or other
  modified_base (982)..(984): a, c, t, g, unknown or other
  modified_base (995)..(995): a, c, t, g, unknown or other
  modified_base (1002)..(1002): a, c, t, g, unknown or other
  modified_base (1005)..(1007): a, c, t, g, unknown or other
  modified_base (1020)..(1020): a, c, t, g, unknown or other
  modified_base (1023)..(1025): a, c, t, g, unknown or other
  modified_base (1027)..(1028): a, c, t, g, unknown or other
  modified_base (1030)..(1033): a, c, t, g, unknown or other
  modified_base (1036)..(1037): a, c, t, g, unknown or other
  modified_base (1048)..(1048): a, c, t, g, unknown or other
  modified_base (1052)..(1052): a, c, t, g, unknown or other
  modified_base (1055)..(1056): a, c, t, g, unknown or other
  modified_base (1062)..(1062): a, c, t, g, unknown or other
  modified_base (1068)..(1069): a, c, t, g, unknown or other
  modified_base (1071)..(1071): a, c, t, g, unknown or other
  modified_base (1074)..(1074): a, c, t, g, unknown or other
  modified_base (1077)..(1078): a, c, t, g, unknown or other
  modified_base (1080)..(1081): a, c, t, g, unknown or other
  modified_base (1084)..(1085): a, c, t, g, unknown or other
  modified_base (1093)..(1098): a, c, t, g, unknown or other
  modified_base (1100)..(1106): a, c, t, g, unknown or other
  modified_base (1109)..(1114): a, c, t, g, unknown or other
  modified_base (1117)..(1117): a, c, t, g, unknown or other
  modified_base (1120)..(1120): a, c, t, g, unknown or other
  modified_base (1125)..(1128): a, c, t, g, unknown or other
  modified_base (1130)..(1130): a, c, t, g, unknown or other
  modified_base (1133)..(1138): a, c, t, g, unknown or other
  modified_base (1140)..(1141): a, c, t, g, unknown or other
nnnnnnnnnnntgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttataccatttgatggaagaaataagtactacgcagactccgtgacgggccgattcaccatctccagagacaattccaagaacacactgtatctgcaaatgaacagcctgagagctgaggacacggctgtgtattactgtgcgagtagtagtggttatcttttccactctgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnaaggtggacaaganagttgagcccaaatcttgtgacaaaactcacacatgcccaccgtgcccagcacctgaactcctggggggaccgtcagtcttcctcttccccccaaaacccannnnacccncatgatctcccnnacccctganncncatgnnnggnggnnncgtgagccacnaagaccntgnnncagttcaactggnacnnngnngnnnnggnngtgcataatgncaanaannaagccncgggannancantannanngcnncgtaccgnnnnnngnnnnnnngtnnnnnncgnccngcacnnnngnaannnnnntnn

SEQ ID NO: 3535 - DNA, 358 bp, Artificial Sequence; identical to SEQ ID NO: 301
  source: /note="Description of Artificial Sequence: Synthetic polynucleotide"

SEQ ID NO: 3536 - DNA, 1032 bp, Artificial Sequence
  source: /note="Description of Artificial Sequence: Synthetic polynucleotide"
  modified_base (1)..(12): a, c, t, g, unknown or other
  modified_base (14)..(14): a, c, t, g, unknown or other
  modified_base (21)..(21): a, c, t, g, unknown or other
  modified_base (25)..(25): a, c, t, g, unknown or other
  modified_base (27)..(27): a, c, t, g, unknown or other
  modified_base (785)..(785): a, c, t, g, unknown or other
  modified_base (881)..(881): a, c, t, g, unknown or other
  modified_base (958)..(958): a, c, t, g, unknown or other
  modified_base (964)..(964): a, c, t, g, unknown or other
  modified_base (966)..(966): a, c, t, g, unknown or other
  modified_base (968)..(968): a, c, t, g, unknown or other
  modified_base (971)..(974): a, c, t, g, unknown or other
  modified_base (982)..(982): a, c, t, g, unknown or other
  modified_base (984)..(984): a, c, t, g, unknown or other
  modified_base (990)..(993): a, c, t, g, unknown or other
  modified_base (997)..(998): a, c, t, g, unknown or other
  modified_base (1008)..(1008): a, c, t, g, unknown or other
  modified_base (1011)..(1011): a, c, t, g, unknown or other
  modified_base (1013)..(1014): a, c, t, g, unknown or other
  modified_base (1018)..(1020): a, c, t, g, unknown or other
  modified_base (1024)..(1024): a, c, t, g, unknown or other
  modified_base (1026)..(1027): a, c, t, g, unknown or other
  modified_base (1029)..(1030): a, c, t, g, unknown or other
  modified_base (1032)..(1032): a, c, t, g, unknown or other
nnnnnnnnnnnntntgtatcntacncntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccttccaccctgtctgcatctgtaggagacagagtcaccatcacttgccgggccagtcagagtattagtaactggttggcctggtttcagcagaaaccagggaaagcccctaagctcctgatctatgaggcgtctagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcngggcctgagctcgcccgtcacaaagagcttcaacaggggagagtgttagaagcttggccgccatggcccaacttgtttattgcagcttataatggntacaaataaagcaatagcatcacaatttcacaaataaagcatttttttcactgcattctagttgtggtttgtccaanctcatnangnatnnnncatgtctngntcgggnnnntcgnngcagcaccanggncnngaannnaccncnnannan

SEQ ID NO: 3537 - DNA, 322 bp, Artificial Sequence
  source: /note="Description of Artificial Sequence: Synthetic polynucleotide"
  modified_base (155)..(155): a, c, t, g, unknown or other
gacatccagatgacccagtctccttccaccctgtctgcatctgtaggagacagagtcaccatcacttgccgggccagtcagagtattagtaactggttggcctggtttcagcagaaaccagggaaagcccctaagctcctgatctatgaggcgtntagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggaaatcaaac

SEQ ID NO: 3538 - DNA, 1133 bp, Artificial Sequence
  source: /note="Description of Artificial Sequence: Synthetic polynucleotide"
  modified_base (1)..(10): a, c, t, g, unknown or other
  modified_base (14)..(14): a, c, t, g, unknown or other
  modified_base (18)..(18): a, c, t, g, unknown or other
  modified_base (24)..(24): a, c, t, g, unknown or other
  modified_base (717)..(718): a, c, t, g, unknown or other
  modified_base (813)..(813): a, c, t, g, unknown or other
  modified_base (815)..(815): a, c, t, g, unknown or other
  modified_base (826)..(826): a, c, t, g, unknown or other
  modified_base (910)..(910): a, c, t, g, unknown or other
  modified_base (923)..(923): a, c, t, g, unknown or other
  modified_base (925)..(929): a, c, t, g, unknown or other
  modified_base (947)..(947): a, c, t, g, unknown or other
  modified_base (969)..(969): a, c, t, g, unknown or other
  modified_base (971)..(974): a, c, t, g, unknown or other
  modified_base (979)..(979): a, c, t, g, unknown or other
  modified_base (986)..(986): a, c, t, g, unknown or other
  modified_base (993)..(995): a, c, t, g, unknown or other
  modified_base (1002)..(1002): a, c, t, g, unknown or other
  modified_base (1004)..(1006): a, c, t, g, unknown or other
  modified_base (1011)..(1012): a, c, t, g, unknown or other
  modified_base (1019)..(1021): a, c, t, g, unknown or other
  modified_base (1024)..(1024): a, c, t, g, unknown or other
  modified_base (1027)..(1028): a, c, t, g, unknown or other
  modified_base (1030)..(1031): a, c, t, g, unknown or other
  modified_base (1034)..(1035): a, c, t, g, unknown or other
  modified_base (1039)..(1039): a, c, t, g, unknown or other
  modified_base (1041)..(1041): a, c, t, g, unknown or other
  modified_base (1045)..(1049): a, c, t, g, unknown or other
  modified_base (1051)..(1051): a, c, t, g, unknown or other
  modified_base (1055)..(1055): a, c, t, g, unknown or other
  modified_base (1057)..(1062): a, c, t, g, unknown or other
  modified_base (1067)..(1071): a, c, t, g, unknown or other
  modified_base (1073)..(1074): a, c, t, g, unknown or other
  modified_base (1082)..(1083): a, c, t, g, unknown or other
  modified_base (1085)..(1088): a, c, t, g, unknown or other
  modified_base (1091)..(1094): a, c, t, g, unknown or other
  modified_base (1096)..(1099): a, c, t, g, unknown or other
  modified_base (1101)..(1103): a, c, t, g, unknown or other
  modified_base (1107)..(1109): a, c, t, g, unknown or other
  modified_base (1111)..(1111): a, c, t, g, unknown or other
  modified_base (1115)..(1117): a, c, t, g, unknown or other
  modified_base (1121)..(1123): a, c, t, g, unknown or other
  modified_base (1127)..(1127): a, c, t, g, unknown or other
  modified_base (1130)..(1133): a, c, t, g, unknown or other
nnnnnnnnnnatgnatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattccgaggtgcagctggtgcagtctggagtagaggtgaaaaagtcgggggagtctctgaagatctcctgtaagggctctggatacaactttgccacctcctggctcggctgggtgcgccagatgcccggcaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcacatataccagtggctggtactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcnnactctactccctcagcagcgtggtgaccgtgccctccagcagcttgggcacccagacctacatctgcaacgtgaatcacaagcccagcaacaccnangtggacaaganagttgagcccaaatcttgtgacaaaactcacacatgcccaccgtgcccagcacctgaactcctggggggaccgtcagtcttccncttccccccaaancnnnnncaccctcatgatctcccngacccctgagtcacatgcgtgngnnnngtganccacganaccctgnnncagtcantnnncgtgnnggcgtgnnngcntanncnnaannagcncnggannnnnantacnannnnnngtacnnnnngnnagcgtccnncnnnntcnnnncnnnntnnngaannnanggannncaannngcanggnnnn

SEQ ID NO: 3539 - DNA, 352 bp, Artificial Sequence
  source: /note="Description of Artificial Sequence: Synthetic polynucleotide"
gaggtgcagctggtgcagtctggagtagaggtgaaaaagtcgggggagtctctgaagatctcctgtaagggctctggatacaactttgccacctcctggctcggctgggtgcgccagatgcccggcaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcacatataccagtggctggtactggggccagggaaccctggtcaccgtctcgtcag

SEQ ID NO: 3540 - DNA, 1073 bp, Artificial Sequence
  source: /note="Description of Artificial Sequence: Synthetic polynucleotide"
  modified_base (1)..(9): a, c, t, g, unknown or other
  modified_base (18)..(18): a, c, t, g, unknown or other
  modified_base (22)..(22): a, c, t, g, unknown or other
  modified_base (795)..(795): a, c, t, g, unknown or other
  modified_base (798)..(799): a, c, t, g, unknown or other
  modified_base (809)..(809): a, c, t, g, unknown or other
  modified_base (812)..(812): a, c, t, g, unknown or other
  modified_base (820)..(820): a, c, t, g, unknown or other
  modified_base (880)..(881): a, c, t, g, unknown or other
  modified_base (886)..(886): a, c, t, g, unknown or other
  modified_base (919)..(919): a, c, t, g, unknown or other
  modified_base (935)..(936): a, c, t, g, unknown or other
  modified_base (948)..(948): a, c, t, g, unknown or other
  modified_base (950)..(955): a, c, t, g, unknown or other
  modified_base (957)..(957): a, c, t, g, unknown or other
  modified_base (959)..(959): a, c, t, g, unknown or other
  modified_base (961)..(961): a, c, t, g, unknown or other
  modified_base (969)..(969): a, c, t, g, unknown or other
  modified_base (971)..(971): a, c, t, g, unknown or other
  modified_base (973)..(973): a, c, t, g, unknown or other
  modified_base (978)..(978): a, c, t, g, unknown or other
  modified_base (985)..(986): a, c, t, g, unknown or other
  modified_base (991)..(991): a, c, t, g, unknown or other
  modified_base (997)..(1001): a, c, t, g, unknown or other
  modified_base (1003)..(1004): a, c, t, g, unknown or other
  modified_base (1007)..(1007): a, c, t, g, unknown or other
  modified_base (1009)..(1011): a, c, t, g, unknown or other
  modified_base (1013)..(1016): a, c, t, g, unknown or other
  modified_base (1018)..(1019): a, c, t, g, unknown or other
  modified_base (1022)..(1023): a, c, t, g, unknown or other
  modified_base (1028)..(1028): a, c, t, g, unknown or other
  modified_base (1033)..(1035): a, c, t, g, unknown or other
  modified_base (1037)..(1038): a, c, t, g, unknown or other
  modified_base (1040)..(1040): a, c, t, g, unknown or other
  modified_base (1044)..(1044): a, c, t, g, unknown or other
  modified_base (1048)..(1049): a, c, t, g, unknown or other
  modified_base (1051)..(1051): a, c, t, g, unknown or other
  modified_base (1056)..(1057): a, c, t, g, unknown or other
  modified_base (1063)..(1069): a, c, t, g, unknown or other
  modified_base (1073)..(1073): a, c, t, g, unknown or other
nnnnnnnnntatgtatcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctccctccgtgtccgggtctcctggacagtcagtcaccatctcctgcactggaaccagcagtgacgttggtagttataaccgtgtctcttggtaccagcagcccccaggcacagcccccaaactcatgatttatgaggtcaataatcggccctcaggggtccctgatcgcttctctgggtccaagtctggcaacacggcctccctgaccatctctgggctccaggctgaagacgaggctgattattactgcagctcatatacaagcagtagcaatttcgatgtcttcggaactgggaccaaggtcaccgtcctaggtcagcccaaggccaaccccactgtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatganggnncaccgtgganaanacagtggnccctacagaatgttcatagaagcttggccgccatggcccaacttgtttattgcagcttannatggntacaaataaagcaatagcatcacaaatttcacnaataaagcattttttnnactgcattctantnnnnnntngncnaactcatnangnatctnatcatgnnctggntcgggnnnnngnncancnnntnnnnannacnntgaanagacnnngnngnactnctgnngnggaannaacatnnnnnnngaan

SEQ ID NO: 3541 - DNA, 334 bp, Artificial Sequence
  source: /note="Description of Artificial Sequence: Synthetic polynucleotide"
cagtctgtgctgactcagcctccctccgtgtccgggtctcctggacagtcagtcaccatctcctgcactggaaccagcagtgacgttggtagttataaccgtgtctcttggtaccagcagcccccaggcacagcccccaaactcatgatttatgaggtcaataatcggccctcaggggtccctgatcgcttctctgggtccaagtctggcaacacggcctccctgaccatctctgggctccaggctgaagacgaggctgattattactgcagctcatatacaagcagtagcaatttcgatgtcttcggaactgggaccaaggtcaccgtcctag

SEQ ID NO: 3542 - DNA, 1094 bp, Artificial Sequence
  source: /note="Description of Artificial Sequence: Synthetic polynucleotide"
  modified_base (1)..(11): a, c, t, g, unknown or other
  modified_base (15)..(15): a, c, t, g, unknown or other
  modified_base (19)..(19): a, c, t, g, unknown or other
  modified_base (25)..(25): a, c, t, g, unknown or other
  modified_base (668)..(668): a, c, t, g, unknown or other
  modified_base (824)..(824): a, c, t, g, unknown or other
  modified_base (829)..(829): a, c, t, g, unknown or other
  modified_base (873)..(873): a, c, t, g, unknown or other
  modified_base (890)..(890): a, c, t, g, unknown or other
  modified_base (930)..(932): a, c, t, g, unknown or other
  modified_base (950)..(950): a, c, t, g, unknown or other
  modified_base (957)..(957): a, c, t, g, unknown or other
  modified_base (972)..(972): a, c, t, g, unknown or other
  modified_base (974)..(974): a, c, t, g, unknown or other
  modified_base (976)..(976): a, c, t, g, unknown or other
  modified_base (982)..(982): a, c, t, g, unknown or other
  modified_base (989)..(989): a, c, t, g, unknown or other
  modified_base (991)..(991): a, c, t, g, unknown or other
  modified_base (1003)..(1003): a, c, t, g, unknown or other
  modified_base (1007)..(1009): a, c, t, g, unknown or other
  modified_base (1011)..(1015): a, c, t, g, unknown or other
  modified_base (1018)..(1020): a, c, t, g, unknown or other
  modified_base (1024)..(1026): a, c, t, g, unknown or other
  modified_base (1032)..(1033): a, c, t, g, unknown or other
  modified_base (1035)..(1036): a, c, t, g, unknown or other
  modified_base (1039)..(1040): a, c, t, g, unknown or other
  modified_base (1044)..(1046): a, c, t, g, unknown or other
  modified_base (1048)..(1048): a, c, t, g, unknown or other
  modified_base (1055)..(1055): a, c, t, g, unknown or other
  modified_base (1058)..(1058): a, c, t, g, unknown or other
  modified_base (1060)..(1060): a, c, t, g, unknown or other
  modified_base (1064)..(1066): a, c, t, g, unknown or other
  modified_base (1068)..(1068): a, c, t, g, unknown or other
  modified_base (1071)..(1071): a, c, t, g, unknown or other
  modified_base (1073)..(1075): a, c, t, g, unknown or other
  modified_base (1077)..(1077): a, c, t, g, unknown or other
  modified_base (1080)..(1080): a, c, t, g, unknown or other
  modified_base (1085)..(1090): a, c, t, g, unknown or other
  modified_base (1092)..(1094): a, c, t, g, unknown or other
nnnnnnnnnnnatgnatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattccgaggtgcagctggtgcagtctggagtagaggtgaaaaagtcgggggagtctctgaagatctcctgtaagggctctggatacaactttgccacctcctggctcggctgggtgcgccagatgcccggcaaaggcctggagtggatggggatcatctatcctggtgactctgataccagatacagcccgtccttccaaggccaggtcaccatttcagccgacaagtccatcagcaccgcctacctgcagtggagcagcctgaaggcctcggacaccgccatgtattactgtgcgagactcatatataccagtggctggtactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaaggtgganaaganagttgagcccaaatcttgtgacaaaactcacacatgcccaccgngcccagcacctgaactnctggggggaccgtcagtcttcctcttccccccaaaacccnnncaccctcatgatctcccngaccccngagtcacatgcgtgngngncgtganccacganancctgagtcagtnactnnncnnnnnggnnnggannngcatanncnnaannagcnnngnagagcantananagcnnntncgngnnngncancgtcnnnnnncnnn

SEQ ID NO: 3543 - DNA, 352 bp, Artificial Sequence
  source: /note="Description of Artificial Sequence: Synthetic polynucleotide"
gaggtgcagctggtgcagtctggagtagaggtgaaaaagtcgggggagtctctgaagatctcctgtaagggctctggatacaactttgccacctcctggctcggctgggtgcgccagatgcccggcaaaggcctggagtggatggggatcatctatcctggtgactctgataccagatacagcccgtccttccaaggccaggtcaccatttcagccgacaagtccatcagcaccgcctacctgcagtggagcagcctgaaggcctcggacaccgccatgtattactgtgcgagactcatatataccagtggctggtactggggccagggaaccctggtcaccgtctcctcag

SEQ ID NO: 3544 - DNA, 1171 bp, Artificial Sequence
  source: /note="Description of Artificial Sequence: Synthetic polynucleotide"
  modified_base (1)..(10): a, c, t, g, unknown or other
  modified_base (18)..(18): a, c, t, g, unknown or other
  modified_base (24)..(24): a, c, t, g, unknown or other
  modified_base (849)..(849): a, c, t, g, unknown or other
  modified_base (887)..(887): a, c, t, g, unknown or other
  modified_base (949)..(949): a, c, t, g, unknown or other
  modified_base (959)..(959): a, c, t, g, unknown or other
  modified_base (963)..(963): a, c, t, g, unknown or other
  modified_base (973)..(973): a, c, t, g, unknown or other
  modified_base (980)..(981): a, c, t, g, unknown or other
  modified_base (1002)..(1003): a, c, t, g, unknown or other
  modified_base (1006)..(1006): a, c, t, g, unknown or other
  modified_base (1013)..(1015): a, c, t, g, unknown or other
  modified_base (1026)..(1027): a, c, t, g, unknown or other
  modified_base (1030)..(1030): a, c, t, g, unknown or other
  modified_base (1041)..(1046): a, c, t, g, unknown or other
  modified_base (1048)..(1049): a, c, t, g, unknown or other
  modified_base (1052)..(1052): a, c, t, g, unknown or other
  modified_base (1058)..(1058): a, c, t, g, unknown or other
  modified_base (1063)..(1063): a, c, t, g, unknown or other
  modified_base (1065)..(1066): a, c, t, g, unknown or other
  modified_base (1069)..(1069): a, c, t, g, unknown or other
  modified_base (1071)..(1072): a, c, t, g, unknown or other
  modified_base (1076)..(1076): a, c, t, g, unknown or other
  modified_base (1078)..(1081): a, c, t, g, unknown or other
  modified_base (1083)..(1083): a, c, t, g, unknown or other
  modified_base (1087)..(1087): a, c, t, g, unknown or other
  modified_base (1089)..(1090): a, c, t, g, unknown or other
  modified_base (1093)..(1097): a, c, t, g, unknown or other
  modified_base (1099)..(1099): a, c, t, g, unknown or other
  modified_base (1101)..(1101): a, c, t, g, unknown or other
  modified_base (1108)..(1110): a, c, t, g, unknown or other
  modified_base (1114)..(1115): a, c, t, g, unknown or other
  modified_base (1119)..(1123): a, c, t, g, unknown or other
  modified_base (1125)..(1127): a, c, t, g, unknown or other
  modified_base (1130)..(1132): a, c, t, g, unknown or other
  modified_base (1137)..(1137): a, c, t, g, unknown or other
  modified_base (1140)..(1148): a, c, t, g, unknown or other
  modified_base (1150)..(1150): a, c, t, g, unknown or other
  modified_base (1153)..(1157): a, c, t, g, unknown or other
  modified_base (1159)..(1163): a, c, t, g, unknown or other
  modified_base (1166)..(1171): a, c, t, g, unknown or other
nnnnnnnnnnatgtatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctccctccgtgtccgggtctcctggacagtcagtcaccatctcctgcactggaaccagcagtgacgttggtagttataaccgtgtctcttggtaccagcagcccccaggcacagcccccaaactcatgatttatgaggtcaataatcggccctcaggggtccctgatcgcttctctgggtccaagtctggcaacacggcctccctgaccatctctgggctccaggctgaagacgaggctgattattactgcagctcatatacaagcagtagcaatttcgatgtcttcggaactgggaccaaggtcaccgtcctaggtcagcccaaggccaaccccactgtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggncgccatggcccaacttgtttattgcagcttataatggntacaaataaagcaatagcatcacaaatttcacaaataaagcatttttttcactgcattctanttgtggtttntccnaactcatcangtatctnncatgtctggatcgggaattanncgncgcagcnnntggcctgaaannacnctgaaagagannnnnngnnctnctgagngaaananntcngnngaangnnnngntcantnnggnnnnngnangtccagnnncccnncagnnnnnannntgnnngcatncannnnnnnnncngcnnnnngnnnnnggnnnnnn

SEQ ID NO: 3545 - DNA, 334 bp, Artificial Sequence
  source: /note="Description of Artificial Sequence: Synthetic polynucleotide"
cagtctgccctgactcagcctccctccgtgtccgggtctcctggacagtcagtcaccatctcctgcactggaaccagcagtgacgttggtagttataaccgtgtctcttggtaccagcagcccccaggcacagcccccaaactcatgatttatgaggtcaataatcggccctcaggggtccctgatcgcttctctgggtccaagtctggcaacacggcctccctgaccatctctgggctccaggctgaagacgaggctgattattactgcagctcatatacaagcagtagcaatttcgatgtcttcggaactgggaccaaggtcaccgtcctag

SEQ ID NO: 3546 - DNA, 1135 bp, Artificial Sequence
  source: /note="Description of Artificial Sequence: Synthetic polynucleotide"
  modified_base (1)..(11): a, c, t, g, unknown or other
  modified_base (19)..(19): a, c, t, g, unknown or other
  modified_base (725)..(725): a, c, t, g, unknown or other
  modified_base (821)..(821): a, c, t, g, unknown or other
  modified_base (831)..(831): a, c, t, g, unknown or other
  modified_base (858)..(858): a, c, t, g, unknown or other
  modified_base (921)..(921): a, c, t, g, unknown or other
  modified_base (965)..(965): a, c, t, g, unknown or other
  modified_base (974)..(974): a, c, t, g, unknown or other
  modified_base (985)..(985): a, c, t, g, unknown or other
  modified_base (995)..(995): a, c, t, g, unknown or other
  modified_base (997)..(999): a, c, t, g, unknown or other
  modified_base (1001)..(1001): a, c, t, g, unknown or other
  modified_base (1010)..(1010): a, c, t, g, unknown or other
  modified_base (1014)..(1014): a, c, t, g, unknown or other
  modified_base (1018)..(1018): a, c, t, g, unknown or other
  modified_base (1022)..(1023): a, c, t, g, unknown or other
  modified_base (1025)..(1026): a, c, t, g, unknown or other
  modified_base (1030)..(1032): a, c, t, g, unknown or other
  modified_base (1044)..(1045): a, c, t, g, unknown or other
  modified_base (1047)..(1052): a, c, t, g, unknown or other
  modified_base (1057)..(1059): a, c, t, g, unknown or other
  modified_base (1062)..(1062): a, c, t, g, unknown or other
  modified_base (1067)..(1067): a, c, t, g, unknown or other
  modified_base (1069)..(1070): a, c, t, g, unknown or other
  modified_base (1076)..(1079): a, c, t, g, unknown or other
  modified_base (1081)..(1081): a, c, t, g, unknown or other
  modified_base (1087)..(1094): a, c, t, g, unknown or other
  modified_base (1096)..(1098): a, c, t, g, unknown or other
  modified_base (1102)..(1102): a, c, t, g, unknown or other
  modified_base (1104)..(1106): a, c, t, g, unknown or other
  modified_base (1110)..(1116): a, c, t, g, unknown or other
  modified_base (1118)..(1120): a, c, t, g, unknown or other
  modified_base (1123)..(1128): a, c, t, g, unknown or other
  modified_base (1133)..(1134): a, c, t, g, unknown or other
nnnnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtccagcctggggggtccctgagactctcctgtgcagcctctggattcacctttagtacctattggatgagctgggtccgccagcctccagggaaggggctggagtgggtggccaacataaagcaagatggaagtgagaaatactatgtggattctgtgaagggccgattcaccatctccagagacaacgccaagaactcactgtatctgcaaatgaacagcctgagagccgacgacacggccgtgtattactgtgccggggggacatggctacgatcctcttttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnaaggtggacnagagagttgagcccaaatcttgtgacnaaactcacacatgcccaccgtgcccagcacctgaactcctggggggaccgtcagtcttcctcntcccccaaacccaaggacaccctcatgatctcccggaccctgantcacatgcntggtggtggangtgagccacnannncntgaggtcantcantggnacgnngnnggcnnngaggtgcataanncnnnnnnaagcnnnggnaggancnntacaannnncncgtacnnnnnnnnannngtcntnnncgtnnnnnnncnnnaannnnnntgaanng

SEQ ID NO: 3547 - DNA, 358 bp, Artificial Sequence; identical to SEQ ID NO: 303
  source: /note="Description of Artificial Sequence: Synthetic polynucleotide"

SEQ ID NO: 3548 - DNA, 1157 bp, Artificial Sequence
  source: /note="Description of Artificial Sequence: Synthetic polynucleotide"
  modified_base (1)..(13): a, c, t, g, unknown or other
  modified_base (20)..(20): a, c, t, g, unknown or other
  modified_base (809)..(809): a, c, t, g, unknown or other
  modified_base (890)..(890): a, c, t, g, unknown or other
  modified_base (903)..(903): a, c, t, g, unknown or other
  modified_base (948)..(948): a, c, t, g, unknown or other
  modified_base (950)..(950): a, c, t, g, unknown or other
  modified_base (952)..(952): a, c, t, g, unknown or other
  modified_base (964)..(964): a, c, t, g, unknown or other
  modified_base (972)..(972): a, c, t, g, unknown or other
  modified_base (974)..(974): a, c, t, g, unknown or other
  modified_base (977)..(981): a, c, t, g, unknown or other
  modified_base (995)..(995): a, c, t, g, unknown or other
  modified_base (999)..(1001): a, c, t, g, unknown or other
  modified_base (1003)..(1009): a, c, t, g, unknown or other
  modified_base (1011)..(1012): a, c, t, g, unknown or other
  modified_base (1014)..(1014): a, c, t, g, unknown or other
  modified_base (1025)..(1026): a, c, t, g, unknown or other
  modified_base (1039)..(1041): a, c, t, g, unknown or other
  modified_base (1043)..(1046): a, c, t, g, unknown or other
  modified_base (1048)..(1048): a, c, t, g, unknown or other
  modified_base (1050)..(1053): a, c, t, g, unknown or other
  modified_base (1057)..(1059): a, c, t, g, unknown or other
  modified_base (1061)..(1064): a, c, t, g, unknown or other
  modified_base (1067)..(1067): a, c, t, g, unknown or other
  modified_base (1069)..(1072): a, c, t, g, unknown or other
  modified_base (1074)..(1077): a, c, t, g, unknown or other
  modified_base (1082)..(1082): a, c, t, g, unknown or other
  modified_base (1084)..(1084): a, c, t, g, unknown or other
  modified_base (1090)..(1091): a, c, t, g, unknown or other
  modified_base (1095)..(1097): a, c, t, g, unknown or other
  modified_base (1102)..(1102): a, c, t, g, unknown or other
  modified_base (1104)..(1104): a, c, t, g, unknown or other
  modified_base (1108)..(1109): a, c, t, g, unknown or other
  modified_base (1113)..(1115): a, c, t, g, unknown or other
  modified_base (1117)..(1120): a, c, t, g, unknown or other
  modified_base (1123)..(1123): a, c, t, g, unknown or other
  modified_base (1131)..(1131): a, c, t, g, unknown or other
  modified_base (1134)..(1134): a, c, t, g, unknown or other
  modified_base (1137)..(1141): a, c, t, g, unknown or other
  modified_base (1144)..(1152): a, c, t, g, unknown or other
  modified_base (1154)..(1154): a, c, t, g, unknown or other
  modified_base (1156)..(1157): a, c, t, g, unknown or other
nnnnnnnnnnnnntgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctacgtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtgganaagacagtggcccctacagaatgttcatagaagcttggccgccatggcccaacttgtttattgcagcttataatggttacnaataaagcaatancatcacaaatttcacaaataaagcatttttttcactgcattctantngnggtttgtccaanctcatcangnatnnnnnatgtctggatcggnattnnngnnnnnnncnncntggcctgaaannacctctgaaagannntnnnngnannnngagnnnannnntcngnnnngnnnngtcantngggtgnngaannnccagntncccnncagnnnannnntgnaagcatgnatntcnnnnncannnnnnnnngngnn

SEQ ID NO: 3549 - DNA, 330 bp, Artificial Sequence; identical to SEQ ID NO: 304
  source: /note="Description of Artificial Sequence: Synthetic polynucleotide"

SEQ ID NO: 3550 - DNA, 1126 bp, Artificial Sequence
  source: /note="Description of Artificial Sequence: Synthetic polynucleotide"
  modified_base (1)..(10): a, c, t, g, unknown or other
  modified_base (14)..(14): a, c, t, g, unknown or other
  modified_base (18)..(18): a, c, t, g, unknown or other
  modified_base (679)..(679): a, c, t, g, unknown or other
  modified_base (729)..(731): a, c, t, g, unknown or other
  modified_base (860)..(861): a, c, t, g, unknown or other
  modified_base (891)..(891): a, c, t, g, unknown or other
  modified_base (899)..(899): a, c, t, g, unknown or other
  modified_base (924)..(924): a, c, t, g, unknown or other
  modified_base (931)..(931): a, c, t, g, unknown or other
  modified_base (934)..(934): a, c, t, g, unknown or other
  modified_base (937)..(937): a, c, t, g, unknown or other
  modified_base (947)..(948): a, c, t, g, unknown or other
  modified_base (957)..(957): a, c, t, g, unknown or other
  modified_base (960)..(961): a, c, t, g, unknown or other
  modified_base (965)..(966): a, c, t, g, unknown or other
  modified_base (981)..(986): a, c, t, g, unknown or other
  modified_base (989)..(989): a, c, t, g, unknown or other
  modified_base (997)..(997): a, c, t, g, unknown or other
  modified_base (999)..(999): a, c, t, g, unknown or other
  modified_base (1013)..(1013): a, c, t, g, unknown or other
  modified_base (1017)..(1017): a, c, t, g, unknown or other
  modified_base (1020)..(1022): a, c, t, g, unknown or other
  modified_base (1024)..(1025): a, c, t, g, unknown or other
  modified_base (1028)..(1031): a, c, t, g, unknown or other
  modified_base (1033)..(1036): a, c, t, g, unknown or other
  modified_base (1039)..(1039): a, c, t, g, unknown or other
  modified_base (1042)..(1043): a, c, t, g, unknown or other
  modified_base (1045)..(1046): a, c, t, g, unknown or other
  modified_base (1048)..(1050): a, c, t, g, unknown or other
  modified_base (1052)..(1054): a, c, t, g, unknown or other
  modified_base (1057)..(1057): a, c, t, g, unknown or other
  modified_base (1060)..(1060): a, c, t, g, unknown or other
  modified_base (1062)..(1062): a, c, t, g, unknown or other
  modified_base (1064)..(1065): a, c, t, g, unknown or other
  modified_base (1070)..(1074): a, c, t, g, unknown or other
  modified_base (1080)..(1084): a, c, t, g, unknown or other
  modified_base (1086)..(1086): a, c, t, g, unknown or other
  modified_base (1091)..(1094): a, c, t, g, unknown or other
  modified_base (1096)..(1098): a, c, t, g, unknown or other
  modified_base (1103)..(1106): a, c, t, g, unknown or other
  modified_base (1109)..(1110): a, c, t, g, unknown or other
  modified_base (1112)..(1114): a, c, t, g, unknown or other
  modified_base (1116)..(1119): a, c, t, g, unknown or other
  modified_base (1122)..(1122): a, c, t, g, unknown or other
  modified_base (1125)..(1125): a, c, t, g, unknown or other
nnnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatgccatgcactgggtccgccaggctccaggcaaggggctggagtgggtggcagttatatcatatgatggaagtaataaatactctgcagactccgtgaagggccgattcaccatctccagagacaattccaagaacacgctgtatctgcaaatgaacagcctgagagctgaggacacggctgtgtattactgtgcgaaagggggggcctacagctactactactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcnnnctctactccctcagcagcgtggtgaccgtgccctccagcagcttgggcacccagacctacatctgcaacgtgaatcacaagcccagcaacaccaaggtggacaagagagttgagcccaaatcttgtgannaaactcacacatgcccaccgtgcccagcanctgaactnctggggggaccgtcagtcttcctcntcccccnaanccnaggacacccnncatgatctnccnnaccnngagtcacatgcgtgnnnnnngtnagcacganancctgagtcagtcantggnacnnngnnggnnnngnnnngcntanncnnannncnnnggnagnancnntacannnnncgtacnnnnngncagcnnnntnnncgtcnnnnccnngnnngnnnnaanggna

SEQ ID NO: 3551 - DNA, 363 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatgccatgcactgggtccgccaggctccaggcaaggggctggagtgggtggcagttatatcatatgatggaagtaataaatactctgcagactccgtgaagggccgattcaccatctccagagacaattccaagaacacgctgtatctgcaaatgaacagcctgagagctgaggacacggctgtgtattactgtgcgaaagggggggcctacagctactactactacatggacgtctggggcaaagggaccacggtcaccgtctcctca

SEQ ID NO: 3552 - DNA, 1091 bp, Artificial Sequence
  source: /note="Description of Artificial Sequence: Synthetic polynucleotide"
  modified_base (1)..(11): a, c, t, g, unknown or other
  modified_base (16)..(16): a, c, t, g, unknown or other
  modified_base (20)..(20): a, c, t, g, unknown or other
  modified_base (26)..(26): a, c, t, g, unknown or other
  modified_base (784)..(784): a, c, t, g, unknown or other
  modified_base (850)..(850): a, c, t, g, unknown or other
  modified_base (859)..(859): a, c, t, g, unknown or other
  modified_base (874)..(874): a, c, t, g, unknown or other
  modified_base (940)..(940): a, c, t, g, unknown or other
  modified_base (942)..(942): a, c, t, g, unknown or other
  modified_base (944)..(945): a, c, t, g, unknown or other
  modified_base (950)..(950): a, c, t, g, unknown or other
  modified_base (957)..(957): a, c, t, g, unknown or other
  modified_base (968)..(968): a, c, t, g, unknown or other
  modified_base (971)..(974): a, c, t, g, unknown or other
  modified_base (984)..(984): a, c, t, g, unknown or other
  modified_base (991)..(991): a, c, t, g, unknown or other
  modified_base (993)..(996): a, c, t, g, unknown or other
  modified_base (998)..(998): a, c, t, g, unknown or other
  modified_base (1004)..(1005): a, c, t, g, unknown or other
  modified_base (1007)..(1007): a, c, t, g, unknown or other
  modified_base (1012)..(1012): a, c, t, g, unknown or other
  modified_base (1017)..(1021): a, c, t, g, unknown or other
  modified_base (1032)..(1032): a, c, t, g, unknown or other
  modified_base (1034)..(1036): a, c, t, g, unknown or other
  modified_base (1039)..(1039): a, c, t, g, unknown or other
  modified_base (1042)..(1043): a, c, t, g, unknown or other
  modified_base (1048)..(1048): a, c, t, g, unknown or other
  modified_base (1050)..(1052): a, c, t, g, unknown or other
  modified_base (1054)..(1054): a, c, t, g, unknown or other
  modified_base (1056)..(1072): a, c, t, g, unknown or other
  modified_base (1078)..(1078): a, c, t, g, unknown or other
  modified_base (1080)..(1085): a, c, t, g, unknown or other
  modified_base (1089)..(1091): a, c, t, g, unknown or other
nnnnnnnnnnntatgnatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcnggcctgagctcgcccgtcacaaagagcttcaacaggggagagtgttagaagcttggccgccatggnccaacttgnttattgcagcttatnatggttacaataaagcaatagcatcacaaatttcacaaataaagcatttttttcactgcattctantngnnggttngtccaanctcatcaatgnatnnnncatgtctggntcgggantnnnngngcagcnncntggcntgaannnnntctgaagagantnnnagnacnntgagngnnncntnnnnnnnnnnnnnnnnntcagtngnnnnnngaannn

SEQ ID NO: 3553 - DNA, 322 bp, Artificial Sequence
  source: /note="Description of Artificial Sequence: Synthetic polynucleotide"
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaac

SEQ ID NO: 3554 - DNA, 1160 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (17)..(17): a, c, t, g, unknown or other
  modified_base (813)..(813): a, c, t, g, unknown or other
  modified_base (815)..(815): a, c, t, g, unknown or other
  modified_base (826)..(826): a, c, t, g, unknown or other
  modified_base (924)..(924): a, c, t, g, unknown or other
  modified_base (938)..(938): a, c, t, g, unknown or other
  modified_base (945)..(945): a, c, t, g, unknown or other
  modified_base (949)..(949): a, c, t, g, unknown or other
  modified_base (956)..(956): a, c, t, g, unknown or other
  modified_base (959)..(959): a, c, t, g, unknown or other
  modified_base (972)..(972): a, c, t, g, unknown or other
  modified_base (974)..(975): a, c, t, g, unknown or other
  modified_base (990)..(990): a, c, t, g, unknown or other
  modified_base (995)..(995): a, c, t, g, unknown or other
  modified_base (1012)..(1012): a, c, t, g, unknown or other
  modified_base (1016)..(1017): a, c, t, g, unknown or other
  modified_base (1019)..(1020): a, c, t, g, unknown or other
  modified_base (1023)..(1026): a, c, t, g, unknown or other
  modified_base (1036)..(1036): a, c, t, g, unknown or other
  modified_base (1038)..(1039): a, c, t, g, unknown or other
  modified_base (1041)..(1043): a, c, t, g, unknown or other
  modified_base (1046)..(1046): a, c, t, g, unknown or other
  modified_base (1052)..(1054): a, c, t, g, unknown or other
  modified_base (1057)..(1057): a, c, t, g, unknown or other
  modified_base (1062)..(1063): a, c, t, g, unknown or other
  modified_base (1068)..(1068): a, c, t, g, unknown or other
  modified_base (1070)..(1071): a, c, t, g, unknown or other
  modified_base (1073)..(1074): a, c, t, g, unknown or other
  modified_base (1080)..(1087): a, c, t, g, unknown or other
  modified_base (1090)..(1090): a, c, t, g, unknown or other
  modified_base (1095)..(1096): a, c, t, g, unknown or other
  modified_base (1098)..(1099): a, c, t, g, unknown or other
  modified_base (1101)..(1107): a, c, t, g, unknown or other
  modified_base (1111)..(1112): a, c, t, g, unknown or other
  modified_base (1114)..(1116): a, c, t, g, unknown or other
  modified_base (1120)..(1120): a, c, t, g, unknown or other
  modified_base (1124)..(1125): a, c, t, g, unknown or other
  modified_base (1127)..(1133): a, c, t, g, unknown or other
  modified_base (1135)..(1136): a, c, t, g, unknown or other
  modified_base (1141)..(1141): a, c, t, g, unknown or other
  modified_base (1143)..(1147): a, c, t, g, unknown or other
  modified_base (1149)..(1152): a, c, t, g, unknown or other
  modified_base (1155)..(1160): a, c, t, g, unknown or other
nnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtccagcctggggggtccctgagactctcctgtgcagcctctggagtcaccgtcagtagcaactacatgagctgggtccgccaggctccagggaaggggctggagtgggtctcacttatttatagcggtggtagcacattctacgcagactccgtgaagggcagattcaccatctccagagacaattccgagaacacgctgtatcttcaaatgaacaccctgagagccgaggacacggctgtgtattactgtgcgagagatctgtattactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnangtggacaaganagttgagcccaaatcttgtgacaaaactcacacatgcccaccgtgcccagcacctgaactcctggggggaccgtcagtcttcctcttccccccaaaanccaaggacaccctnatgatcncccngaccccngantcacatgcgtggngnngacgtgagccacganacccngagtcagttcaactggnacgnngnnggnnnnggaggtgcananncnnnaanaagccnnnggnaggannagtananngnncgtacnnnnnnnncancgtcnncnncnnnnnnncagnntnnngaanggcnngnnnnnnnanngcaangnnnnncnnnnaannnnnn

SEQ ID NO: 3555 - DNA, 351 bp, Artificial Sequence; identical to SEQ ID NO: 307
  source: /note="Description of Artificial Sequence: Synthetic polynucleotide"

SEQ ID NO: 3556 - DNA, 1161 bp, Artificial Sequence
  source: /note="Description of Artificial Sequence: Synthetic polynucleotide"
  modified_base (1)..(13): a, c, t, g, unknown or other
  modified_base (15)..(15): a, c, t, g, unknown or other
  modified_base (19)..(19): a, c, t, g, unknown or other
  modified_base (685)..(685): a, c, t, g, unknown or other
  modified_base (732)..(732): a, c, t, g, unknown or other
  modified_base (879)..(879): a, c, t, g, unknown or other
  modified_base (941)..(941): a, c, t, g, unknown or other
  modified_base (945)..(945): a, c, t, g, unknown or other
  modified_base (948)..(948): a, c, t, g, unknown or other
  modified_base (952)..(952): a, c, t, g, unknown or other
  modified_base (963)..(965): a, c, t, g, unknown or other
  modified_base (967)..(967): a, c, t, g, unknown or other
  modified_base (970)..(970): a, c, t, g, unknown or other
  modified_base (972)..(972): a, c, t, g, unknown or other
  modified_base (982)..(982): a, c, t, g, unknown or other
  modified_base (986)..(986): a, c, t, g, unknown or other
  modified_base (988)..(990): a, c, t, g, unknown or other
  modified_base (992)..(992): a, c, t, g, unknown or other
  modified_base (998)..(998): a, c, t, g, unknown or other
  modified_base (1005)..(1005): a, c, t, g, unknown or other
  modified_base (1007)..(1007): a, c, t, g, unknown or other
  modified_base (1009)..(1012): a, c, t, g, unknown or other
  modified_base (1015)..(1016): a, c, t, g, unknown or other
  modified_base (1019)..(1019): a, c, t, g, unknown or other
  modified_base (1025)..(1025): a, c, t, g, unknown or other
  modified_base (1028)..(1035): a, c, t, g, unknown or other
  modified_base (1038)..(1040): a, c, t, g, unknown or other
  modified_base (1044)..(1044): a, c, t, g, unknown or other
  modified_base (1048)..(1048): a, c, t, g, unknown or other
  modified_base (1052)..(1052): a, c, t, g, unknown or other
  modified_base (1054)..(1055): a, c, t, g, unknown or other
  modified_base (1058)..(1058): a, c, t, g, unknown or other
  modified_base (1061)..(1067): a, c, t, g, unknown or other
  modified_base (1073)..(1073): a, c, t, g, unknown or other
  modified_base (1076)..(1077): a, c, t, g, unknown or other
  modified_base (1079)..(1080): a, c, t, g, unknown or other
  modified_base (1090)..(1091): a, c, t, g, unknown or other
  modified_base (1093)..(1093): a, c, t, g, unknown or other
  modified_base (1095)..(1095): a, c, t, g, unknown or other
  modified_base (1098)..(1098): a, c, t, g, unknown or other
  modified_base (1100)..(1100): a, c, t, g, unknown or other
  modified_base (1104)..(1104): a, c, t, g, unknown or other
  modified_base (1106)..(1106): a, c, t, g, unknown or other
  modified_base (1108)..(1110): a, c, t, g, unknown or other
  modified_base (1113)..(1115): a, c, t, g, unknown or other
  modified_base (1118)..(1118): a, c, t, g, unknown or other
  modified_base (1124)..(1125): a, c, t, g, unknown or other
  modified_base (1128)..(1134): a, c, t, g, unknown or other
  modified_base (1136)..(1137): a, c, t, g, unknown or other
  modified_base (1139)..(1139): a, c, t, g, unknown or other
  modified_base (1141)..(1144): a, c, t, g, unknown or other
  modified_base (1150)..(1150): a, c, t, g, unknown or other
  modified_base (1153)..(1161): a, c, t, g, unknown or other
nnnnnnnnnnnnngnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttactcttacacttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcangacagcaaggacagcacctacagcctcagcagcaccctgacgctgancaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggntacaaataaagcaatagcatcacaaatttcacaaataaagcatttttttcactgcattctanttgnggnttgnccaaactcatnnngnatntntcatgtctgnatcngnnntnattcgncgcagcncntnnnnaannacnctgaanagnnnnnnnnacnnngagngaanaacntnntgngannnnnnntcagtnggnngnngaaagtcccnngntnccnancagnanannntgnnncangcattnncannnnnnncnncngnnnnggaaantcnnnnnnnnn

SEQ ID NO: 3557 - DNA, 322 bp, Artificial Sequence; identical to SEQ ID NO: 308
  source: /note="Description of Artificial Sequence: Synthetic polynucleotide"

SEQ ID NO: 3558 - DNA, 1138 bp, Artificial Sequence
  source: /note="Description of Artificial Sequence: Synthetic polynucleotide"
  modified_base (1)..(9): a, c, t, g, unknown or other
  modified_base (17)..(17): a, c, t, g, unknown or other
  modified_base (23)..(23): a, c, t, g, unknown or other
  modified_base (687)..(687): a, c, t, g, unknown or other
  modified_base (835)..(837): a, c, t, g, unknown or other
  modified_base (846)..(846): a, c, t, g, unknown or other
  modified_base (928)..(930): a, c, t, g, unknown or other
  modified_base (941)..(941): a, c, t, g, unknown or other
  modified_base (946)..(948): a, c, t, g, unknown or other
  modified_base (950)..(950): a, c, t, g, unknown or other
  modified_base (953)..(953): a, c, t, g, unknown or other
  modified_base (963)..(963): a, c, t, g, unknown or other
  modified_base (966)..(967): a, c, t, g, unknown or other
  modified_base (970)..(971): a, c, t, g, unknown or other
  modified_base (979)..(979): a, c, t, g, unknown or other
  modified_base (982)..(983): a, c, t, g, unknown or other
  modified_base (988)..(988): a, c, t, g, unknown or other
  modified_base (990)..(992): a, c, t, g, unknown or other
  modified_base (994)..(995): a, c, t, g, unknown or other
  modified_base (1000)..(1000): a, c, t, g, unknown or other
  modified_base (1002)..(1002): a, c, t, g, unknown or other
  modified_base (1004)..(1004): a, c, t, g, unknown or other
  modified_base (1006)..(1006): a, c, t, g, unknown or other
  modified_base (1008)..(1008): a, c, t, g, unknown or other
  modified_base (1024)..(1026): a, c, t, g, unknown or other
  modified_base (1028)..(1028): a, c, t, g, unknown or other
  modified_base (1031)..(1038): a, c, t, g, unknown or other
  modified_base (1041)..(1043): a, c, t, g, unknown or other
  modified_base (1046)..(1047): a, c, t, g, unknown or other
  modified_base (1049)..(1050): a, c, t, g, unknown or other
  modified_base (1052)..(1057): a, c, t, g, unknown or other
  modified_base (1059)..(1059): a, c, t, g, unknown or other
  modified_base (1061)..(1063): a, c, t, g, unknown or other
  modified_base (1066)..(1067): a, c, t, g, unknown or other
  modified_base (1069)..(1069): a, c, t, g, unknown or other
  modified_base (1073)..(1073): a, c, t, g, unknown or other
  modified_base (1076)..(1077): a, c, t, g, unknown or other
  modified_base (1079)..(1080): a, c, t, g, unknown or other
  modified_base (1082)..(1084): a, c, t, g, unknown or other
  modified_base (1086)..(1091): a, c, t, g, unknown or other
  modified_base (1093)..(1093): a, c, t, g, unknown or other
  modified_base (1096)..(1096): a, c, t, g, unknown or other
  modified_base (1098)..(1107): a, c, t, g, unknown or other
  modified_base (1112)..(1118): a, c, t, g, unknown or other
  modified_base (1120)..(1123): a, c, t, g, unknown or other
  modified_base (1125)..(1125): a, c, t, g, unknown or other
  modified_base (1128)..(1130): a, c, t, g, unknown or other
  modified_base (1134)..(1138): a, c, t, g, unknown or other
nnnnnnnnnatgtatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcgtggtccagcctgggaggtccctgagactctcctgtgcagcctctggattcaccttcagtagctatgctatgttctgggtccgccaggctccgggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagggcggatttaggatattgtactaatggtgtatgctatgttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccannnggacaaganagttgagcccaaatcttgtgacaaaactcacacatgcccaccgtgcccagcacctgactcctggggggaccgtcagtcttcnnntcccccaaaanccaannnanccntcatgatctnccnnccnngagtcacntgnngtggngnnngnngtgancncnanancctgagtcagtcactnnncntgnnnnnnnngannngcnnanncnnnnnnancnnngannanagtncanngnncnnncnnnnnngncancnnnnnnnnnnccgtnnnnnnncnnnngnaannnggcnnnnn

SEQ ID NO: 3559 - DNA, 372 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtagctatgctatgttctgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagggcggatttaggatattgtactaatggtgtatgctatgttgactactggggccagggaaccctggtcaccgtctcctca

SEQ ID NO: 3560 - DNA, 1142 bp, Artificial Sequence
  source: /note="Description of Artificial Sequence: Synthetic polynucleotide"
  modified_base (1)..(10): a, c, t, g, unknown or other
  modified_base (15)..(15): a, c, t, g, unknown or other
  modified_base (19)..(19): a, c, t, g, unknown or other
  modified_base (807)..(808): a, c, t, g, unknown or other
  modified_base (899)..(899): a, c, t, g, unknown or other
  modified_base (942)..(942): a, c, t, g, unknown or other
  modified_base (946)..(946): a, c, t, g, unknown or other
  modified_base (948)..(948): a, c, t, g, unknown or other
  modified_base (950)..(950): a, c, t, g, unknown or other
  modified_base (969)..(972): a, c, t, g, unknown or other
  modified_base (975)..(977): a, c, t, g, unknown or other
  modified_base (997)..(999): a, c, t, g, unknown or other
  modified_base (1001)..(1001): a, c, t, g, unknown or other
  modified_base (1003)..(1003): a, c, t, g, unknown or other
  modified_base (1008)..(1008): a, c, t, g, unknown or other
  modified_base (1010)..(1010): a, c, t, g, unknown or other
  modified_base (1012)..(1012): a, c, t, g, unknown or other
  modified_base (1020)..(1021): a, c, t, g, unknown or other
  modified_base (1031)..(1031): a, c, t, g, unknown or other
  modified_base (1033)..(1035): a, c, t, g, unknown or other
  modified_base (1037)..(1039): a, c, t, g, unknown or other
  modified_base (1045)..(1045): a, c, t, g, unknown or other
  modified_base (1047)..(1047): a, c, t, g, unknown or other
  modified_base (1051)..(1051): a, c, t, g, unknown or other
  modified_base (1056)..(1057): a, c, t, g, unknown or other
  modified_base (1059)..(1060): a, c, t, g, unknown or other
  modified_base (1065)..(1065): a, c, t, g, unknown or other
  modified_base (1067)..(1072): a, c, t, g, unknown or other
  modified_base (1080)..(1080): a, c, t, g, unknown or other
  modified_base (1084)..(1084): a, c, t, g, unknown or other
  modified_base (1086)..(1091): a, c, t, g, unknown or other
  modified_base (1094)..(1094): a, c, t, g, unknown or other
  modified_base (1096)..(1096): a, c, t, g, unknown or other
  modified_base (1098)..(1098): a, c, t, g, unknown or other
  modified_base (1102)..(1106): a, c, t, g, unknown or other
  modified_base (1108)..(1108): a, c, t, g, unknown or other
  modified_base (1110)..(1110): a, c, t, g, unknown or other
  modified_base (1112)..(1114): a, c, t, g, unknown or other
  modified_base (1126)..(1126): a, c, t, g, unknown or other
  modified_base (1128)..(1129): a, c, t, g, unknown or other
  modified_base (1131)..(1133): a, c, t, g, unknown or other
  modified_base (1135)..(1135): a, c, t, g, unknown or other
  modified_base (1137)..(1137): a, c, t, g, unknown or other
  modified_base (1141)..(1142): a, c, t, g, unknown or other
nnnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggnnaagacagtggcccctacagaatgttcatagaagcttggccgccatggcccaacttgtttattgcagcttataatggttacaaataaagcanagcatcacaaatttcacaaataaagcatttttttcactgcatnctantngnggtttgtccaaactcatcnnnnatnnntcatgtctggatcgggaatnnntngncgcancncntgcctgannacctctgaanannntnnngtactncngagngaaannanntctgngnnnnnngtcagttngggngnnnnnnccngntncccnnnnngnanannntgcaagcatgcntnntnnntnantcann

SEQ ID NO: 3561 - skipped

SEQ ID NO: 3562 - DNA, 375 bp, Artificial Sequence
  source: /note="Description of Artificial Sequence: Synthetic polynucleotide"
gaggtgcagctggtggagtctgggggaggcttggtccagccgggggggtccctgagactctcctgtgcagcctctggattcagtgtcagcacgaagtacatgacatgggtccgtcaggctccagggaagggactggagtgggtctcagctctttacagcggtggtagtgattactacgcagactccgtgaagggcagattcaccatctccagagacaattccaagaacactttatatcttcaaatgagcagcttgagagtcgaggacacgggtgtttattactgtgccagagactcgtcggaagtccgtgaccaccccgggcacccagggcgctcggtgggggcttttgatatttggggccaagggacaatggtc

SEQ ID NO: 3563 - DNA, 1230 bp, Artificial Sequence
  source: /note="Description of Artificial Sequence: Synthetic polynucleotide"
  modified_base (1)..(10): a, c, t, g, unknown or other
  modified_base (12)..(14): a, c, t, g, unknown or other
  modified_base (16)..(17): a, c, t, g, unknown or other
  modified_base (19)..(20): a, c, t, g, unknown or other
  modified_base (24)..(24): a, c, t, g, unknown or other
  modified_base (803)..(803): a, c, t, g, unknown or other
  modified_base (960)..(960): a, c, t, g, unknown or other
  modified_base (992)..(992): a, c, t, g, unknown or other
  modified_base (1014)..(1014): a, c, t, g, unknown or other
  modified_base (1028)..(1028): a, c, t, g, unknown or other
  modified_base (1034)..(1034): a, c, t, g, unknown or other
  modified_base (1048)..(1050): a, c, t, g, unknown or other
  modified_base (1056)..(1057): a, c, t, g, unknown or other
  modified_base (1063)..(1063): a, c, t, g, unknown or other
  modified_base (1068)..(1068): a, c, t, g, unknown or other
  modified_base (1071)..(1071): a, c, t, g, unknown or other
  modified_base (1073)..(1073): a, c, t, g, unknown or other
  modified_base (1078)..(1081): a, c, t, g, unknown or other
  modified_base (1083)..(1084): a, c, t, g, unknown or other
  modified_base (1090)..(1093): a, c, t, g, unknown or other
  modified_base (1099)..(1101): a, c, t, g, unknown or other
  modified_base (1106)..(1111): a, c, t, g, unknown or other
  modified_base (1114)..(1115): a, c, t, g, unknown or other
  modified_base (1125)..(1127): a, c, t, g, unknown or other
  modified_base (1134)..(1135): a, c, t, g, unknown or other
  modified_base (1137)..(1137): a, c, t, g, unknown or other
  modified_base (1139)..(1140): a, c, t, g, unknown or other
  modified_base (1142)..(1144): a, c, t, g, unknown or other
  modified_base (1148)..(1149): a, c, t, g, unknown or other
  modified_base (1151)..(1165): a, c, t, g, unknown or other
  modified_base (1172)..(1172): a, c, t, g, unknown or other
  modified_base (1174)..(1176): a, c, t, g, unknown or other
  modified_base (1180)..(1194): a, c, t, g, unknown or other
  modified_base (1197)..(1197): a, c, t, g, unknown or other
  modified_base (1200)..(1203): a, c, t, g, unknown or other
  modified_base (1206)..(1206): a, c, t, g, unknown or other
  modified_base (1209)..(1211): a, c, t, g, unknown or other
  modified_base (1213)..(1227): a, c, t, g, unknown or other
  modified_base (1229)..(1229): a, c, t, g, unknown or other
nnnnnnnnnntnnngnntnntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcanggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctanttgtggtttgtccaaactcatcaatgtatctnatcatgtctggatcgggaattnattcggcgcagcancatggncctgaaataacctnnnaaagannacttgnttagnacntnctgannnnannacatcnnnngaatgnnngtcannnnnnggnngaaagtcccnnnctccccnncngnnannntgcnnannnnnnnnnnnnnnncagcacngnnngaannnnnnnnnnnnnnngcnaannnncancannnannnnnnnnnnnnnnnanc

SEQ ID NO: 3564 - DNA, 340 bp, Artificial Sequence
  source: /note="Description of Artificial Sequence: Synthetic polynucleotide"
  modified_base (43)..(43): a, c, t, g, unknown or other
gacatcgtgatgacccagtctccagactccctggctgtgtctntgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaac

SEQ ID NO: 3565 - DNA, 1270 bp, Artificial Sequence
  source: /note="Description of Artificial Sequence: Synthetic polynucleotide"
  modified_base (1)..(10): a, c, t, g, unknown or other
  modified_base (14)..(14): a, c, t, g, unknown or other
  modified_base (18)..(18): a, c, t, g, unknown or other
  modified_base (852)..(852): a, c, t, g, unknown or other
  modified_base (885)..(887): a, c, t, g, unknown or other
  modified_base (890)..(890): a, c, t, g, unknown or other
  modified_base (892)..(892): a, c, t, g, unknown or other
  modified_base (894)..(895): a, c, t, g, unknown or other
  modified_base (897)..(898): a, c, t, g, unknown or other
  modified_base (900)..(900): a, c, t, g, unknown or other
  modified_base (906)..(907): a, c, t, g, unknown or other
  modified_base (911)..(911): a, c, t, g, unknown or other
  modified_base (915)..(915): a, c, t, g, unknown or other
  modified_base (922)..(922): a, c, t, g, unknown or other
  modified_base (926)..(926): a, c, t, g, unknown or other
  modified_base (928)..(928): a, c, t, g, unknown or other
  modified_base (930)..(932): a, c, t, g, unknown or other
  modified_base (934)..(935): a, c, t, g, unknown or other
  modified_base (943)..(943): a, c, t, g, unknown or other
  modified_base (945)..(946): a, c, t, g, unknown or other
  modified_base (950)..(952): a, c, t, g, unknown or other
  modified_base (955)..(955): a, c, t, g, unknown or other
  modified_base (957)..(957): a, c, t, g, unknown or other
  modified_base (976)..(976): a, c, t, g, unknown or other
  modified_base (984)..(985): a, c, t, g, unknown or other
  modified_base (1003)..(1003): a, c, t, g, unknown or other
  modified_base (1011)..(1013): a, c, t, g, unknown or other
  modified_base (1019)..(1020): a, c, t, g, unknown or other
  modified_base (1023)..(1024): a, c, t, g, unknown or other
  modified_base (1026)..(1026): a, c, t, g, unknown or other
  modified_base (1029)..(1029): a, c, t, g, unknown or other
  modified_base (1039)..(1040): a, c, t, g, unknown or other
  modified_base (1043)..(1043): a, c, t, g, unknown or other
  modified_base (1045)..(1046): a, c, t, g, unknown or other
  modified_base (1051)..(1052): a, c, t, g, unknown or other
  modified_base (1055)..(1057): a, c, t, g, unknown or other
  modified_base (1059)..(1059): a, c, t, g, unknown or other
  modified_base (1062)..(1064): a, c, t, g, unknown or other
  modified_base (1066)..(1068): a, c, t, g, unknown or other
  modified_base (1070)..(1071): a, c, t, g, unknown or other
  modified_base (1076)..(1077): a, c, t, g, unknown or other
  modified_base (1080)..(1081): a, c, t, g, unknown or other
  modified_base (1085)..(1085): a, c, t, g, unknown or other
  modified_base (1091)..(1091): a, c, t, g, unknown or other
  modified_base (1093)..(1094): a, c, t, g, unknown or other
  modified_base (1096)..(1096): a, c, t, g, unknown or other
  modified_base (1098)..(1098): a, c, t, g, unknown or other
  modified_base (1103)..(1106): a, c, t, g, unknown or other
  modified_base (1109)..(1111): a, c, t, g, unknown or other
  modified_base (1113)..(1113): a, c, t, g, unknown or other
  modified_base (1115)..(1115): a, c, t, g, unknown or other
  modified_base (1118)..(1119): a, c, t, g, unknown or other
  modified_base (1123)..(1129): a, c, t, g, unknown or other
  modified_base (1135)..(1140): a, c, t, g, unknown or other
  modified_base (1142)..(1142): a, c, t, g, unknown or other
  modified_base (1144)..(1145): a, c, t, g, unknown or other
  modified_base (1147)..(1152): a, c, t, g, unknown or other
  modified_base (1157)..(1162): a, c, t, g, unknown or other
  modified_base (1164)..(1164): a, c, t, g, unknown or other
  modified_base (1166)..(1176): a, c, t, g, unknown or other
  modified_base (1178)..(1179): a, c, t, g, unknown or other
  modified_base (1183)..(1199): a, c, t, g, unknown or other
  modified_base (1201)..(1203): a, c, t, g, unknown or other
  modified_base (1205)..(1208): a, c, t, g, unknown or other
  modified_base (1211)..(1211): a, c, t, g, unknown or other
  modified_base (1213)..(1216): a, c, t, g, unknown or other
  modified_base (1222)..(1223): a, c, t, g, unknown or other
  modified_base (1225)..(1225): a, c, t, g, unknown or other
  modified_base (1227)..(1232): a, c, t, g, unknown or other
  modified_base (1234)..(1242): a, c, t, g, unknown or other
  modified_base (1244)..(1245): a, c, t, g, unknown or other
  modified_base (1247)..(1247): a, c, t, g, unknown or other
  modified_base (1249)..(1251): a, c, t, g, unknown or other
  modified_base (1254)..(1254): a, c, t, g, unknown or other
  modified_base (1256)..(1270): a, c, t, g, unknown or other
nnnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtccagccgggggggtccctgagactctcctgtgcagcctctggattcagtgtcagcaccaagtacatgacatgggtccgtcaggctccagggaaggggctggagtgggtctcagttctttacagcggtggtagtgattactacgcagactccgtgaagggcagattcaccatctccagagacaattccaagaacgctttatatcttcaaatgaacagcttgagagtcgaggacacgggtgtttattactgtgccagagactcgtcggaagtccgtgaccaccccgggcacccagggcgctcggtgggggcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgannnaantnanncnngnccatgnnccgnccgngcccagnactngnannncnnggggggancnntcannnttncntcttccccccaaaacccanggacaccnncatgatctcccggacccntgagtcannntggcgnnggnngnggncgtgagccannaanannctganncannnantgnnncnnngnngggcnnggnnggtncataangnnananaagcnnnnggnnngnancannacannnnnnntaccgnnnnnnancnncnnnnnncgtcnnnnnncngnnnnnnnnnnngnnaggnnnnnnnnnnnnnnnnnannnannnnctncnnnncccatnngnannnnnntnnnnnnnnnanngncnnnccncnnnnnnnnnnnnnnn

SEQ ID NO: 3566 - DNA, 388 bp, Artificial Sequence; identical to SEQ ID NO: 311
  source: /note="Description of Artificial Sequence: Synthetic polynucleotide"

SEQ ID NO: 3567 - DNA, 1249 bp, Artificial Sequence
  source: /note="Description of Artificial Sequence: Synthetic polynucleotide"
  modified_base (1)..(8): a, c, t, g, unknown or other
  modified_base (11)..(16): a, c, t, g, unknown or other
  modified_base (19)..(21): a, c, t, g, unknown or other
  modified_base (25)..(25): a, c, t, g, unknown or other
  modified_base (945)..(945): a, c, t, g, unknown or other
  modified_base (948)..(948): a, c, t, g, unknown or other
  modified_base (950)..(950): a, c, t, g, unknown or other
  modified_base (1006)..(1006): a, c, t, g, unknown or other
  modified_base (1009)..(1010): a, c, t, g, unknown or other
  modified_base (1016)..(1016): a, c, t, g, unknown or other
  modified_base (1024)..(1026): a, c, t, g, unknown or other
  modified_base (1033)..(1033): a, c, t, g, unknown or other
  modified_base (1046)..(1046): a, c, t, g, unknown or other
  modified_base (1052)..(1055): a, c, t, g, unknown or other
  modified_base (1058)..(1058): a, c, t, g, unknown or other
  modified_base (1069)..(1073): a, c, t, g, unknown or other
  modified_base (1077)..(1077): a, c, t, g, unknown or other
  modified_base (1079)..(1080): a, c, t, g, unknown or other
  modified_base (1083)..(1085): a, c, t, g, unknown or other
  modified_base (1087)..(1088): a, c, t, g, unknown or other
  modified_base (1091)..(1096): a, c, t, g, unknown or other
  modified_base (1098)..(1101): a, c, t, g, unknown or other
  modified_base (1105)..(1105): a, c, t, g, unknown or other
  modified_base (1107)..(1108): a, c, t, g, unknown or other
  modified_base (1110)..(1110): a, c, t, g, unknown or other
  modified_base (1112)..(1113): a, c, t, g, unknown or other
  modified_base (1120)..(1122): a, c, t, g, unknown or other
  modified_base (1126)..(1129): a, c, t, g, unknown or other
  modified_base (1131)..(1131): a, c, t, g, unknown or other
  modified_base (1133)..(1133): a, c, t, g, unknown or other
  modified_base (1135)..(1137): a, c, t, g, unknown or other
  modified_base (1141)..(1144): a, c, t, g, unknown or other
  modified_base (1147)..(1147): a, c, t, g, unknown or other
  modified_base (1151)..(1158): a, c, t, g, unknown or other
  modified_base (1161)..(1161): a, c, t, g, unknown or other
  modified_base (1164)..(1169): a, c, t, g, unknown or other
  modified_base (1171)..(1178): a, c, t, g, unknown or other
  modified_base (1181)..(1185): a, c, t, g, unknown or other
  modified_base (1188)..(1190): a, c, t, g, unknown or other
  modified_base (1192)..(1193): a, c, t, g, unknown or other
  modified_base (1195)..(1196): a, c, t, g, unknown or other
  modified_base (1201)..(1204): a, c, t, g, unknown or other
  modified_base (1206)..(1206): a, c, t, g, unknown or other
  modified_base (1208)..(1209): a, c, t, g, unknown or other
  modified_base (1211)..(1217): a, c, t, g, unknown or other
  modified_base (1219)..(1230): a, c, t, g, unknown or other
  modified_base (1233)..(1233): a, c, t, g, unknown or other
  modified_base (1235)..(1237): a, c, t, g, unknown or other
  modified_base (1239)..(1243): a, c, t, g, unknown or other
  modified_base (1246)..(1249): a, c, t, g, unknown or other
nnnnnnnnccnnnnnntannntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcaatgatgttgggagttatacccttgtctcctggtaccaacagtacccaggcaaagcccccaaactcttaatttttgagggcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcatnccnanttgtggtttgtccaaactcatcaatgtatcttatcatgtctggatcgggaattaanttnngcgcancaccatgnnntgaaatnacctctgaaagangaactnnnntangtaccttctgnnnnnaagnanntcnnngnntgnnnnnncnnnngggngnngnanntcccagnnncccnnnngnanannnatgnnnnatncatnnnnnnnncancannnnnngnnnnnnnnccnnnnnccnnngnnanntgcannnnangnnannnnnnntnnnnnnnnnnnncanannncnnnnnccnnnn

SEQ ID NO: 3568 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcaatgatgttgggagttatacccttgtctcctggtaccaacagtacccaggcaaagcccccaaactcttaatttttgagggcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctag

SEQ ID NO: 3569 - DNA, 1195 bp, Artificial Sequence
  source: /note="Description of Artificial Sequence: Synthetic polynucleotide"
  modified_base (2)..(9): a, c, t, g, unknown or other
  modified_base (13)..(13): a, c, t, g, unknown or other
  modified_base (17)..(17): a, c, t, g, unknown or other
  modified_base (759)..(759): a, c, t, g, unknown or other
  modified_base (775)..(775): a, c, t, g, unknown or other
  modified_base (787)..(788): a, c, t, g, unknown or other
  modified_base (790)..(790): a, c, t, g, unknown or other
  modified_base (792)..(793): a, c, t, g, unknown or other
  modified_base (795)..(795): a, c, t, g, unknown or other
  modified_base (802)..(802): a, c, t, g, unknown or other
  modified_base (805)..(805): a, c, t, g, unknown or other
  modified_base (813)..(814): a, c, t, g, unknown or other
  modified_base (817)..(818): a, c, t, g, unknown or other
  modified_base (822)..(822): a, c, t, g, unknown or other
  modified_base (826)..(827): a, c, t, g, unknown or other
  modified_base (830)..(831): a, c, t, g, unknown or other
  modified_base (839)..(839): a, c, t, g, unknown or other
  modified_base (842)..(842): a, c, t, g, unknown or other
  modified_base (847)..(847): a, c, t, g, unknown or other
  modified_base (849)..(849): a, c, t, g, unknown or other
  modified_base (857)..(857): a, c, t, g, unknown or other
  modified_base (859)..(860): a, c, t, g, unknown or other
  modified_base (867)..(867): a, c, t, g, unknown or other
  modified_base (869)..(871): a, c, t, g, unknown or other
  modified_base (873)..(873): a, c, t, g, unknown or other
  modified_base (878)..(878): a, c, t, g, unknown or other
  modified_base (883)..(883): a, c, t, g, unknown or other
  modified_base (895)..(895): a, c, t, g, unknown or other
  modified_base (918)..(918): a, c, t, g, unknown or other
  modified_base (929)..(929): a, c, t, g, unknown or other
  modified_base (931)..(931): a, c, t, g, unknown or other
  modified_base (936)..(936): a, c, t, g, unknown or other
  modified_base (947)..(947): a, c, t, g, unknown or other
  modified_base (953)..(953): a, c, t, g, unknown or other
  modified_base (956)..(957): a, c, t, g, unknown or other
  modified_base (959)..(959): a, c, t, g, unknown or other
  modified_base (963)..(964): a, c, t, g, unknown or other
  modified_base (967)..(967): a, c, t, g, unknown or other
  modified_base (969)..(974): a, c, t, g, unknown or other
  modified_base (978)..(978): a, c, t, g, unknown or other
  modified_base (985)..(985): a, c, t, g, unknown or other
  modified_base (988)..(989): a, c, t, g, unknown or other
  modified_base (993)..(993): a, c, t, g, unknown or other
  modified_base (1000)..(1001): a, c, t, g, unknown or other
  modified_base (1004)..(1006): a, c, t, g, unknown or other
  modified_base (1010)..(1011): a, c, t, g, unknown or other
  modified_base (1013)..(1015): a, c, t, g, unknown or other
  modified_base (1019)..(1019): a, c, t, g, unknown or other
  modified_base (1021)..(1022): a, c, t, g, unknown or other
  modified_base (1025)..(1025): a, c, t, g, unknown or other
  modified_base (1029)..(1029): a, c, t, g, unknown or other
  modified_base (1033)..(1033): a, c, t, g, unknown or other
  modified_base (1042)..(1044): a, c, t, g, unknown or other
  modified_base (1046)..(1046): a, c, t, g, unknown or other
  modified_base (1049)..(1050): a, c, t, g, unknown or other
  modified_base (1052)..(1058): a, c, t, g, unknown or other
  modified_base (1060)..(1061): a, c, t, g, unknown or other
  modified_base (1064)..(1064): a, c, t, g, unknown or other
  modified_base (1066)..(1067): a, c, t, g, unknown or other
  modified_base (1069)..(1070): a, c, t, g, unknown or other
  modified_base (1072)..(1073): a, c, t, g, unknown or other
  modified_base (1075)..(1075): a, c, t, g, unknown or other
  modified_base (1077)..(1086): a, c, t, g, unknown or other
  modified_base (1089)..(1094): a, c, t, g, unknown or other
  modified_base (1097)..(1097): a, c, t, g, unknown or other
  modified_base (1099)..(1100): a, c, t, g, unknown or other
  modified_base (1102)..(1103): a, c, t, g, unknown or other
  modified_base (1106)..(1109): a, c, t, g, unknown or other
  modified_base (1112)..(1114): a, c, t, g, unknown or other
  modified_base (1119)..(1124): a, c, t, g, unknown or other
  modified_base (1126)..(1126): a, c, t, g, unknown or other
  modified_base (1128)..(1128): a, c, t, g, unknown or other
  modified_base (1131)..(1157): a, c, t, g, unknown or other
  modified_base (1159)..(1159): a, c, t, g, unknown or other
  modified_base (1161)..(1162): a, c, t, g, unknown or other
  modified_base (1164)..(1166): a, c, t, g, unknown or other
  modified_base (1168)..(1171): a, c, t, g, unknown or other
  modified_base (1174)..(1180): a, c, t, g, unknown or other
  modified_base (1182)..(1182): a, c, t, g, unknown or other
  modified_base (1184)..(1185): a, c, t, g, unknown or other
  modified_base (1187)..(1195): a, c, t, g, unknown or other
annnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcaccgtcagtaacaactacatgagctgggtccgccaggctccagggaaggggctggagtgggtctcagttatttatagcggtggtagcacatactacgcagactccgtgaagggccgattcaccatctccagagacaaatccaagaacacgctgtatcttcaaataaacaggctgagagccgaggacacggccgtgtattattgtgcgagagaaggggaggtagaagggtataacgatttttggagtggttattctagagaccgttactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcangactctactccctcancagcgtgggganncngnncncctccancantttgggcnnccnnaaanctannttnngcaacgtnaantcaanancccagcancnnccaaggngnnnanaaaanttgancccaaatcttgngacaaaactcacacatgccccancgtgcccagcncngactnctggggggacntcagtntcnntncccnnaancnnnnnncctnatgatcnccnncccngagtcanntgnnngtgnngnnntgancnnganaccngagncagtcactnnncntgnngnnnnnnngnncananncnnannancnnnnnnnnnncannnnnngtncnngnngtnnnntcnnncgtcnnnnnngnantgnnnnnnnnnnnnnnnnnnnnnnnnnnnancnncnnncnnnnaannnnnnncnanncnnnnnnnnn

SEQ ID NO: 3570 - DNA, 394 bp, Artificial Sequence; identical to SEQ ID NO: 313
  source: /note="Description of Artificial Sequence: Synthetic polynucleotide"

SEQ ID NO: 3571 - DNA, 1237 bp, Artificial Sequence
  source: /note="Description of Artificial Sequence: Synthetic polynucleotide"
  modified_base (1)..(14): a, c, t, g, unknown or other
  modified_base (17)..(18): a, c, t, g, unknown or other
  modified_base (20)..(21): a, c, t, g, unknown or other
  modified_base (24)..(25): a, c, t, g, unknown or other
  modified_base (993)..(993): a, c, t, g, unknown or other
  modified_base (1008)..(1008): a, c, t, g, unknown or other
  modified_base (1010)..(1010): a, c, t, g, unknown or other
  modified_base (1012)..(1012): a, c, t, g, unknown or other
  modified_base (1015)..(1015): a, c, t, g, unknown or other
  modified_base (1017)..(1017): a, c, t, g, unknown or other
  modified_base (1035)..(1037): a, c, t, g, unknown or other
  modified_base (1045)..(1047): a, c, t, g, unknown or other
  modified_base (1054)..(1054): a, c, t, g, unknown or other
  modified_base (1056)..(1056): a, c, t, g, unknown or other
  modified_base (1067)..(1067): a, c, t, g, unknown or other
  modified_base (1069)..(1069): a, c, t, g, unknown or other
  modified_base (1072)..(1073): a, c, t, g, unknown or other
  modified_base (1075)..(1077): a, c, t, g, unknown or other
  modified_base (1082)..(1083): a, c, t, g, unknown or other
  modified_base (1087)..(1092): a, c, t, g, unknown or other
  modified_base (1099)..(1099): a, c, t, g, unknown or other
  modified_base (1102)..(1107): a, c, t, g, unknown or other
  modified_base (1116)..(1116): a, c, t, g, unknown or other
  modified_base (1118)..(1120): a, c, t, g, unknown or other
  modified_base (1124)..(1127): a, c, t, g, unknown or other
  modified_base (1129)..(1131): a, c, t, g, unknown or other
  modified_base (1134)..(1137): a, c, t, g, unknown or other
  modified_base (1154)..(1158): a, c, t, g, unknown or other
  modified_base (1163)..(1172): a, c, t, g, unknown or other
  modified_base (1175)..(1176): a, c, t, g, unknown or other
  modified_base (1178)..(1178): a, c, t, g, unknown or other
  modified_base (1182)..(1185): a, c, t, g, unknown or other
  modified_base (1187)..(1190): a, c, t, g, unknown or other
  modified_base (1194)..(1202): a, c, t, g, unknown or other
  modified_base (1204)..(1214): a, c, t, g, unknown or other
  modified_base (1216)..(1224): a, c, t, g, unknown or other
  modified_base (1226)..(1228): a, c, t, g, unknown or other
  modified_base (1233)..(1233): a, c, t, g, unknown or other
  modified_base (1236)..(1237): a, c, t, g, unknown or other
nnnnnnnnnnnnnntgnntnntanncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcgagtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggntcgggaattaattcngngncancnccatggcctgaaataacnnntgaaagannncttggtngnaccttctgagngnaannannntctgnngaannnnnntcagttnggnnnnnnaagtccccngnnncccnnnngnnnaannnngcaagcatgcatctcannnnnagcannnnnnnnnnccnngntccnnnngnnnntgcnnnnnnnnnannnnnnnnnnncnnnnnnnnncnnnccccntann

SEQ ID NO: 3572 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcgagtcttcggaactgggaccaaggtcaccgtcctag

SEQ ID NO: 3573 - DNA, 1249 bp, Artificial Sequence
  source: /note="Description of Artificial Sequence: Synthetic polynucleotide"
  modified_base (1)..(9): a, c, t, g, unknown or other
  modified_base (13)..(14): a, c, t, g, unknown or other
  modified_base (17)..(17): a, c, t, g, unknown or other
  modified_base (708)..(708): a, c, t, g, unknown or other
  modified_base (759)..(759): a, c, t, g, unknown or other
  modified_base (855)..(855): a, c, t, g, unknown or other
  modified_base (869)..(869): a, c, t, g, unknown or other
  modified_base (1008)..(1008): a, c, t, g, unknown or other
  modified_base (1011)..(1011): a, c, t, g, unknown or other
  modified_base (1014)..(1014): a, c, t, g, unknown or other
  modified_base (1017)..(1017): a, c, t, g, unknown or other
  modified_base (1020)..(1020): a, c, t, g, unknown or other
  modified_base (1025)..(1026): a, c, t, g, unknown or other
  modified_base (1031)..(1031): a, c, t, g, unknown or other
  modified_base (1034)..(1034): a, c, t, g, unknown or other
  modified_base (1036)..(1036): a, c, t, g, unknown or other
  modified_base (1043)..(1044): a, c, t, g, unknown or other
  modified_base (1056)..(1056): a, c, t, g, unknown or other
  modified_base (1061)..(1063): a, c, t, g, unknown or other
  modified_base (1066)..(1069): a, c, t, g, unknown or other
  modified_base (1071)..(1075): a, c, t, g, unknown or other
  modified_base (1079)..(1087): a, c, t, g, unknown or other
  modified_base (1089)..(1090): a, c, t, g, unknown or other
  modified_base (1094)..(1097): a, c, t, g, unknown or other
  modified_base (1099)..(1099): a, c, t, g, unknown or other
  modified_base (1102)..(1102): a, c, t, g, unknown or other
  modified_base (1107)..(1108): a, c, t, g, unknown or other
  modified_base (1110)..(1111): a, c, t, g, unknown or other
  modified_base (1113)..(1114): a, c, t, g, unknown or other
  modified_base (1116)..(1117): a, c, t, g, unknown or other
  modified_base (1119)..(1119): a, c, t, g, unknown or other
  modified_base (1121)..(1121): a, c, t, g, unknown or other
  modified_base (1123)..(1123): a, c, t, g, unknown or other
  modified_base (1125)..(1125): a, c, t, g, unknown or other
  modified_base (1127)..(1131): a, c, t, g, unknown or other
  modified_base (1133)..(1134): a, c, t, g, unknown or other
  modified_base (1136)..(1138): a, c, t, g, unknown or other
  modified_base (1141)..(1147): a, c, t, g, unknown or other
  modified_base (1149)..(1150): a, c, t, g, unknown or other
  modified_base (1152)..(1155): a, c, t, g, unknown or other
  modified_base (1157)..(1168): a, c, t, g, unknown or other
  modified_base (1170)..(1171): a, c, t, g, unknown or other
  modified_base (1173)..(1181): a, c, t, g, unknown or other
  modified_base (1183)..(1183): a, c, t, g, unknown or other
  modified_base (1185)..(1185): a, c, t, g, unknown or other
  modified_base (1187)..(1190): a, c, t, g, unknown or other
  modified_base (1192)..(1221): a, c, t, g, unknown or other
  modified_base (1223)..(1227): a, c, t, g, unknown or other
  modified_base (1229)..(1232): a, c, t, g, unknown or other
  modified_base (1234)..(1237): a, c, t, g, unknown or other
  modified_base (1239)..(1240): a, c, t, g, unknown or other
  modified_base (1242)..(1244): a, c, t, g, unknown or other
  modified_base (1246)..(1249): a, c, t, g, unknown or other
nnnnnnnnnatgnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcagcgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagcctgagagccgaggacacggccgtgtattactgtgcgagagaaggggaggtagaagggtattacgatttttggagtggttattctagagaccgttactactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctccagcagcttgggcacccagacctacatctgcaacgtgaatcacaagcccagcaacaccnaaggtggacaaganagttgagcccaaatcttgtgacaaaactcacacatgcccaccgtgcccagcacctgactcctggggggaccgtcagtcttcctcttccccccaaacccaaggacaccctcatgatctcccggacccctgagtcacatgncgnggnggnggncgtgnnccacnaanancctgagnnagttcaactggnacgtnnnggnnnngnnnnngcannnnnnnnnannaaannnncnggnaggannannannannancncntncnnnnngnncnnncgnnnnnnncnncnnnncnnnnnnnnnnnnanngnnnnnnnnnananannnnannnnnnnnnnnnnnnnnnnnnnnnnnnnnncnnnnncnnnncnnnngnnannngnnnn

SEQ ID NO: 3574 - skipped

SEQ ID NO: 3575 - DNA, 1202 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (14)..(14): a, c, t, g, unknown or other
  modified_base (17)..(18): a, c, t, g, unknown or other
  modified_base (905)..(908): a, c, t, g, unknown or other
  modified_base (969)..(969): a, c, t, g, unknown or other
  modified_base (973)..(973): a, c, t, g, unknown or other
  modified_base (975)..(976): a, c, t, g, unknown or other
  modified_base (985)..(986): a, c, t, g, unknown or other
  modified_base (993)..(993): a, c, t, g, unknown or other
  modified_base (997)..(997): a, c, t, g, unknown or other
  modified_base (1000)..(1000): a, c, t, g, unknown or other
  modified_base (1002)..(1002): a, c, t, g, unknown or other
  modified_base (1004)..(1009): a, c, t, g, unknown or other
  modified_base (1013)..(1014): a, c, t, g, unknown or other
  modified_base (1016)..(1016): a, c, t, g, unknown or other
  modified_base (1020)..(1021): a, c, t, g, unknown or other
  modified_base (1024)..(1024): a, c, t, g, unknown or other
  modified_base (1027)..(1028): a, c, t, g, unknown or other
  modified_base (1030)..(1032): a, c, t, g, unknown or other
  modified_base (1034)..(1034): a, c, t, g, unknown or other
  modified_base (1037)..(1039): a, c, t, g, unknown or other
  modified_base (1042)..(1042): a, c, t, g, unknown or other
  modified_base (1047)..(1050): a, c, t, g, unknown or other
  modified_base (1054)..(1054): a, c, t, g, unknown or other
  modified_base (1058)..(1066): a, c, t, g, unknown or other
  modified_base (1069)..(1069): a, c, t, g, unknown or other
  modified_base (1071)..(1072): a, c, t, g, unknown or other
  modified_base (1076)..(1076): a, c, t, g, unknown or other
  modified_base (1078)..(1080): a, c, t, g, unknown or other
  modified_base (1082)..(1082): a, c, t, g, unknown or other
  modified_base (1084)..(1085): a, c, t, g, unknown or other
  modified_base (1087)..(1087): a, c, t, g, unknown or other
  modified_base (1089)..(1090): a, c, t, g, unknown or other
  modified_base (1096)..(1101): a, c, t, g, unknown or other
  modified_base (1104)..(1106): a, c, t, g, unknown or other
  modified_base (1109)..(1110): a, c, t, g, unknown or other
  modified_base (1112)..(1114): a, c, t, g, unknown or other
  modified_base (1117)..(1120): a, c, t, g, unknown or other
  modified_base (1122)..(1128): a, c, t, g, unknown or other
  modified_base (1130)..(1130): a, c, t, g, unknown or other
  modified_base (1132)..(1133): a, c, t, g, unknown or other
  modified_base (1135)..(1135): a, c, t, g, unknown or other
  modified_base (1140)..(1143): a, c, t, g, unknown or other
  modified_base (1146)..(1148): a, c, t, g, unknown or other
  modified_base (1150)..(1154): a, c, t, g, unknown or other
  modified_base (1156)..(1162): a, c, t, g, unknown or other
  modified_base (1165)..(1173): a, c, t, g, unknown or other
  modified_base (1175)..(1175): a, c, t, g, unknown or other
  modified_base (1177)..(1178): a, c, t, g, unknown or other
  modified_base (1181)..(1184): a, c, t, g, unknown or other
  modified_base (1187)..(1187): a, c, t, g, unknown or other
  modified_base (1189)..(1198): a, c, t, g, unknown or other
  modified_base (1200)..(1202): a, c, t, g, unknown or other
nnnnnncnntatgnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcaccactcgagtcttcggaactgggaccagggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatnnnnaatttcacaaataaagcatttttttcactgcattctagttgtggtttgtccaaactcatcnatgnannttatcatgnnctggatngggnatnantnnnnnnagcnncntggnntgnaanncnnntnaannnganttggnnnngtancttnnnnnnnnnggnannaccntnnngngnngngnntcagtnnnnnngannnccnngnnnccnnnngnnnnnnngnanncntgcannnnatnnncnnnnngnnnnnnnagnnnnnnnnnangnnaannnnaancnnnnnnnnnnannn

SEQ ID NO: 3576 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcaccactcgagtcttcggaactgggaccagggtcaccgtcctag

SEQ ID NO: 3577 - DNA, 1199 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (17)..(17): a, c, t, g, unknown or other
  modified_base (729)..(729): a, c, t, g, unknown or other
  modified_base (797)..(797): a, c, t, g, unknown or other
  modified_base (803)..(805): a, c, t, g, unknown or other
  modified_base (809)..(809): a, c, t, g, unknown or other
  modified_base (814)..(815): a, c, t, g, unknown or other
  modified_base (822)..(823): a, c, t, g, unknown or other
  modified_base (825)..(825): a, c, t, g, unknown or other
  modified_base (827)..(827): a, c, t, g, unknown or other
  modified_base (829)..(829): a, c, t, g, unknown or other
  modified_base (832)..(832): a, c, t, g, unknown or other
  modified_base (834)..(835): a, c, t, g, unknown or other
  modified_base (839)..(842): a, c, t, g, unknown or other
  modified_base (846)..(846): a, c, t, g, unknown or other
  modified_base (849)..(849): a, c, t, g, unknown or other
  modified_base (851)..(851): a, c, t, g, unknown or other
  modified_base (855)..(856): a, c, t, g, unknown or other
  modified_base (862)..(862): a, c, t, g, unknown or other
  modified_base (894)..(894): a, c, t, g, unknown or other
  modified_base (927)..(927): a, c, t, g, unknown or other
  modified_base (941)..(943): a, c, t, g, unknown or other
  modified_base (959)..(959): a, c, t, g, unknown or other
  modified_base (964)..(965): a, c, t, g, unknown or other
  modified_base (968)..(969): a, c, t, g, unknown or other
  modified_base (973)..(973): a, c, t, g, unknown or other
  modified_base (979)..(984): a, c, t, g, unknown or other
  modified_base (997)..(997): a, c, t, g, unknown or other
  modified_base (1001)..(1001): a, c, t, g, unknown or other
  modified_base (1004)..(1004): a, c, t, g, unknown or other
  modified_base (1014)..(1016): a, c, t, g, unknown or other
  modified_base (1018)..(1019): a, c, t, g, unknown or other
  modified_base (1021)..(1022): a, c, t, g, unknown or other
  modified_base (1028)..(1032): a, c, t, g, unknown or other
  modified_base (1037)..(1037): a, c, t, g, unknown or other
  modified_base (1040)..(1041): a, c, t, g, unknown or other
  modified_base (1048)..(1048): a, c, t, g, unknown or other
  modified_base (1055)..(1057): a, c, t, g, unknown or other
  modified_base (1061)..(1063): a, c, t, g, unknown or other
  modified_base (1065)..(1066): a, c, t, g, unknown or other
  modified_base (1068)..(1070): a, c, t, g, unknown or other
  modified_base (1073)..(1073): a, c, t, g, unknown or other
  modified_base (1075)..(1076): a, c, t, g, unknown or other
  modified_base (1078)..(1079): a, c, t, g, unknown or other
  modified_base (1081)..(1081): a, c, t, g, unknown or other
  modified_base (1084)..(1084): a, c, t, g, unknown or other
  modified_base (1086)..(1086): a, c, t, g, unknown or other
  modified_base (1089)..(1091): a, c, t, g, unknown or other
  modified_base (1093)..(1093): a, c, t, g, unknown or other
  modified_base (1099)..(1102): a, c, t, g, unknown or other
  modified_base (1104)..(1106): a, c, t, g, unknown or other
  modified_base (1108)..(1109): a, c, t, g, unknown or other
  modified_base (1111)..(1113): a, c, t, g, unknown or other
  modified_base (1116)..(1122): a, c, t, g, unknown or other
  modified_base (1125)..(1132): a, c, t, g, unknown or other
  modified_base (1134)..(1135): a, c, t, g, unknown or other
  modified_base (1138)..(1142): a, c, t, g, unknown or other
  modified_base (1144)..(1164): a, c, t, g, unknown or other
  modified_base (1168)..(1172): a, c, t, g, unknown or other
  modified_base (1174)..(1181): a, c, t, g, unknown or other
  modified_base (1183)..(1184): a, c, t, g, unknown or other
  modified_base (1186)..(1187): a, c, t, g, unknown or other
  modified_base (1189)..(1190): a, c, t, g, unknown or other
  modified_base (1193)..(1193): a, c, t, g, unknown or other
  modified_base (1196)..(1199): a, c, t, g, unknown or other
nnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcctggtcaagcctggggggtccctgagactctcctgtgcagcctctggactcaccttcactgcctatagaatgaattgggtccgccaggctccagggaaggggctggagtggctctcatcaattagtaatacaaatggcgacatatactatgcagactcagtgaagggccgattcaccatctccagagacaacgccaagaattctctgtatctgcaaatgaacagcctgagggccgacgacacggctgtatattactgtgcgagagatgttgcatctaactacgcttactttgacctttggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggantctactccctcagcagcgtggtgaccgtgccctccagcagcttgggcacccagacctacatctgcaangtgaannncaancccannaacaccnnangngnganannagannnnaganccnanattnntgaganaaaactcacacatgccccaccgtgcccagcanctgaactcctggggggaccgtcagtcttcctcntcccccaaacccannncacctcatgatctccngaccnnganncacntgcgtnnnnnncgtgagccacganaccngantcagtcactnnncnngnnggcgtnnnnncatangcnnacaagcncgggagnnnagtnnnanngnnngtncnngnngncancntcnnncntcctgnnnngnnngnntnnntgnnnnnnntannnnnnnngnntcnnnnnannnnnnnnnnnnnnnnnnnnncaannnnngnnnnnnnnanncnngnntanccnnnn

SEQ ID NO: 3578 - DNA, 361 bp, Artificial Sequence; identical to SEQ ID NO: 317
  source: /note="Description of Artificial Sequence: Synthetic polynucleotide"

SEQ ID NO: 3579 - DNA, 1211 bp, Artificial Sequence
  source: /note="Description of Artificial Sequence: Synthetic polynucleotide"
  modified_base (1)..(8): a, c, t, g, unknown or other
  modified_base (16)..(16): a, c, t, g, unknown or other
  modified_base (832)..(832): a, c, t, g, unknown or other
  modified_base (874)..(874): a, c, t, g, unknown or other
  modified_base (880)..(880): a, c, t, g, unknown or other
  modified_base (890)..(890): a, c, t, g, unknown or other
  modified_base (894)..(894): a, c, t, g, unknown or other
  modified_base (909)..(910): a, c, t, g, unknown or other
  modified_base (913)..(913): a, c, t, g, unknown or other
  modified_base (922)..(923): a, c, t, g, unknown or other
  modified_base (925)..(925): a, c, t, g, unknown or other
  modified_base (927)..(928): a, c, t, g, unknown or other
  modified_base (931)..(931): a, c, t, g, unknown or other
  modified_base (936)..(936): a, c, t, g, unknown or other
  modified_base (940)..(940): a, c, t, g, unknown or other
  modified_base (942)..(943): a, c, t, g, unknown or other
  modified_base (954)..(954): a, c, t, g, unknown or other
  modified_base (957)..(959): a, c, t, g, unknown or other
  modified_base (961)..(964): a, c, t, g, unknown or other
  modified_base (966)..(967): a, c, t, g, unknown or other
  modified_base (969)..(969): a, c, t, g, unknown or other
  modified_base (973)..(973): a, c, t, g, unknown or other
  modified_base (976)..(982): a, c, t, g, unknown or other
  modified_base (984)..(985): a, c, t, g, unknown or other
  modified_base (987)..(987): a, c, t, g, unknown or other
  modified_base (989)..(989): a, c, t, g, unknown or other
  modified_base (992)..(995): a, c, t, g, unknown or other
  modified_base (998)..(1000): a, c, t, g, unknown or other
  modified_base (1002)..(1004): a, c, t, g, unknown or other
  modified_base (1006)..(1008): a, c, t, g, unknown or other
  modified_base (1010)..(1012): a, c, t, g, unknown or other
  modified_base (1014)..(1019): a, c, t, g, unknown or other
  modified_base (1022)..(1022): a, c, t, g, unknown or other
  modified_base (1026)..(1026): a, c, t, g, unknown or other
  modified_base (1029)..(1031): a, c, t, g, unknown or other
  modified_base (1038)..(1038): a, c, t, g, unknown or other
  modified_base (1041)..(1042): a, c, t, g, unknown or other
  modified_base (1052)..(1052): a, c, t, g, unknown or other
  modified_base (1054)..(1058): a, c, t, g, unknown or other
  modified_base (1064)..(1064): a, c, t, g, unknown or other
  modified_base (1070)..(1072): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1082)..(1082): a, c, t, g, unknown or other
  modified_base (1085)..(1085): a, c, t, g, unknown or other
  modified_base (1087)..(1091): a, c, t, g, unknown or other
  modified_base (1094)..(1094): a, c, t, g, unknown or other
  modified_base (1096)..(1096): a, c, t, g, unknown or other
  modified_base (1099)..(1106): a, c, t, g, unknown or other
  modified_base (1111)..(1111): a, c, t, g, unknown or other
  modified_base (1113)..(1113): a, c, t, g, unknown or other
  modified_base (1115)..(1115): a, c, t, g, unknown or other
  modified_base (1118)..(1119): a, c, t, g, unknown or other
  modified_base (1123)..(1125): a, c, t, g, unknown or other
  modified_base (1128)..(1131): a, c, t, g, unknown or other
  modified_base (1133)..(1133): a, c, t, g, unknown or other
  modified_base (1135)..(1135): a, c, t, g, unknown or other
  modified_base (1143)..(1145): a, c, t, g, unknown or other
  modified_base (1148)..(1151): a, c, t, g, unknown or other
  modified_base (1153)..(1158): a, c, t, g, unknown or other
  modified_base (1160)..(1163): a, c, t, g, unknown or other
  modified_base (1166)..(1167): a, c, t, g, unknown or other
  modified_base (1170)..(1181): a, c, t, g, unknown or other
  modified_base (1183)..(1189): a, c, t, g, unknown or other
  modified_base (1191)..(1194): a, c, t, g, unknown or other
  modified_base (1196)..(1211): a, c, t, g, unknown or other
nnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacattggtgtttataactatatctcctggagccaacaacacccaggcaaagcccccaaagtcatgatttatgatgtcactaatcggccctcaggggtttctaatcgcttctctggctccaagtctggcaacacggcctccctgaccatctctgggctccaggctgaggacgaggctgattattattgcagctcatatagaggcagcagcactccctatgtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgntcatagaagcttggccgccatggcccaacttgtttattgcancttatnatggttacgnatanagcaatagcatcacnntcncacatttcnnanannaanctttntttntnnctgcattctanttnnngnnnngnncnaacntcnnnnnnngnntncntannnnggnnngnnncnnnannnannnnnncancacntgnnntgaaatnacnnctgaagagantnnnnngtactnctgagnnnanacntcngngangnnnnncantnggnnnnnnnnccccngntnccnncagnnnaannnngnancatgcatnnnatnnnncnnnnnngnnnngannccnnnnnnnnnnnngnnnnnnntnnnnannnnnnnnnnnnnnnn

SEQ ID NO: 3580 - DNA, 334 bp, Artificial Sequence
  source: /note="Description of Artificial Sequence: Synthetic polynucleotide"
  modified_base (328)..(328): a, c, t, g, unknown or other
cagtctgccctgactcagcctgcctccgtgtctgggtctcctggacagtcgatcaccatctcctgcactggaaccagcagtgacattggtgtttataactatatctcctggagccaacaacacccaggcaaagcccccaaagtcatgatttatgatgtcactaatcggccctcaggggtttctaatcgcttctctggctccaagtctggcaacacggcctccctgaccatctctgggctccaggctgaggacgaggctgattattattgcagctcatatagaggcagcagcactccctatgtcttcggaactgggaccaaggtcaccntcctag

SEQ ID NO: 3581 - DNA, 1268 bp, Artificial Sequence
  source: /note="Description of Artificial Sequence: Synthetic polynucleotide"
  modified_base (1)..(12): a, c, t, g, unknown or other
  modified_base (17)..(21): a, c, t, g, unknown or other
  modified_base (926)..(926): a, c, t, g, unknown or other
  modified_base (932)..(932): a, c, t, g, unknown or other
  modified_base (951)..(951): a, c, t, g, unknown or other
  modified_base (971)..(971): a, c, t, g, unknown or other
  modified_base (992)..(992): a, c, t, g, unknown or other
  modified_base (1005)..(1005): a, c, t, g, unknown or other
  modified_base (1007)..(1007): a, c, t, g, unknown or other
  modified_base (1013)..(1013): a, c, t, g, unknown or other
  modified_base (1015)..(1015): a, c, t, g, unknown or other
  modified_base (1027)..(1027): a, c, t, g, unknown or other
  modified_base (1029)..(1030): a, c, t, g, unknown or other
  modified_base (1033)..(1033): a, c, t, g, unknown or other
  modified_base (1041)..(1041): a, c, t, g, unknown or other
  modified_base (1045)..(1046): a, c, t, g, unknown or other
  modified_base (1049)..(1052): a, c, t, g, unknown or other
  modified_base (1055)..(1055): a, c, t, g, unknown or other
  modified_base (1062)..(1062): a, c, t, g, unknown or other
  modified_base (1065)..(1068): a, c, t, g, unknown or other
  modified_base (1072)..(1072): a, c, t, g, unknown or other
  modified_base (1074)..(1081): a, c, t, g, unknown or other
  modified_base (1085)..(1091): a, c, t, g, unknown or other
  modified_base (1093)..(1093): a, c, t, g, unknown or other
  modified_base (1095)..(1098): a, c, t, g, unknown or other
  modified_base (1100)..(1106): a, c, t, g, unknown or other
  modified_base (1108)..(1108): a, c, t, g, unknown or other
  modified_base (1112)..(1122): a, c, t, g, unknown or other
  modified_base (1124)..(1125): a, c, t, g, unknown or other
  modified_base (1130)..(1133): a, c, t, g, unknown or other
  modified_base (1135)..(1136): a, c, t, g, unknown or other
  modified_base (1138)..(1139): a, c, t, g, unknown or other
  modified_base (1141)..(1141): a, c, t, g, unknown or other
  modified_base (1145)..(1148): a, c, t, g, unknown or other
  modified_base (1151)..(1158): a, c, t, g, unknown or other
  modified_base (1160)..(1162): a, c, t, g, unknown or other
  modified_base (1166)..(1172): a, c, t, g, unknown or other
  modified_base (1174)..(1177): a, c, t, g, unknown or other
  modified_base (1179)..(1183): a, c, t, g, unknown or other
  modified_base (1185)..(1189): a, c, t, g, unknown or other
  modified_base (1193)..(1193): a, c, t, g, unknown or other
  modified_base (1195)..(1195): a, c, t, g, unknown or other
  modified_base (1197)..(1200): a, c, t, g, unknown or other
  modified_base (1202)..(1202): a, c, t, g, unknown or other
  modified_base (1204)..(1205): a, c, t, g, unknown or other
  modified_base (1208)..(1208): a, c, t, g, unknown or other
  modified_base (1210)..(1210): a, c, t, g, unknown or other
  modified_base (1213)..(1224): a, c, t, g, unknown or other
  modified_base (1227)..(1227): a, c, t, g, unknown or other
  modified_base (1230)..(1233): a, c, t, g, unknown or other
  modified_base (1236)..(1238): a, c, t, g, unknown or other
  modified_base (1242)..(1243): a, c, t, g, unknown or other
  modified_base (1245)..(1247): a, c, t, g, unknown or other
  modified_base (1250)..(1256): a, c, t, g, unknown or other
  modified_base (1258)..(1260): a, c, t, g, unknown or other
  modified_base (1262)..(1266): a, c, t, g, unknown or other
  modified_base (1268)..(1268): a, c, t, g, unknown or other
nnnnnnnnnnnntatgnnnnnacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattccgaggtgcagctggtgcagtctggagcagaggtgaaaaagcccggggagtctctgaagatctcctgtaagggttctggatacagatttaccaactactggatcggctgggtgcgccagatgcccgggaaaggcctggagtggatggggatcatctatcctggtgactctgataccagatacagcccgtccttccaaggccaggtcaccatctcagccgacaagtccatcaccaccgcctacctgcagtggagcagcctgaaggcctcggacaccgccatgtattactgtgcgagactcagtgaccgctggtacagtccgttcgacccctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttncccccnaaacccaaggacaccctcntgatctcccggacccctgangtcacatgcgtggtggtggangtgagccacgaanancctgangncaggtcaactgntnngtngacggcgngganntgnnnntgncaagacnaannnnacangnnnnnnnnggannnnnnnangnnnngnnnnnnncngggnnnnnnnnnnncnnccccnnnncnngnncngaannnnagnnnnnnnngnnngatnnnnnnntnnnngnnnnncnnnnncccntncnnnncncnntcnanaannnnnnnnnnnnccnaannnngcnnncccnncnnnaannnnnnngnnngnnnnncn

SEQ ID NO: 3582 - DNA, 361 bp, Artificial Sequence; identical to SEQ ID NO: 319
  source: /note="Description of Artificial Sequence: Synthetic polynucleotide"

SEQ ID NO: 3583 - DNA, 1241 bp, Artificial Sequence
  source: /note="Description of Artificial Sequence: Synthetic polynucleotide"
  modified_base (1)..(8): a, c, t, g, unknown or other
  modified_base (12)..(12): a, c, t, g, unknown or other
  modified_base (14)..(14): a, c, t, g, unknown or other
  modified_base (18)..(18): a, c, t, g, unknown or other
  modified_base (946)..(946): a, c, t, g, unknown or other
  modified_base (955)..(957): a, c, t, g, unknown or other
  modified_base (976)..(978): a, c, t, g, unknown or other
  modified_base (986)..(986): a, c, t, g, unknown or other
  modified_base (990)..(991): a, c, t, g, unknown or other
  modified_base (999)..(999): a, c, t, g, unknown or other
  modified_base (1001)..(1005): a, c, t, g, unknown or other
  modified_base (1007)..(1011): a, c, t, g, unknown or other
  modified_base (1013)..(1014): a, c, t, g, unknown or other
  modified_base (1016)..(1038): a, c, t, g, unknown or other
  modified_base (1040)..(1047): a, c, t, g, unknown or other
  modified_base (1050)..(1052): a, c, t, g, unknown or other
  modified_base (1054)..(1056): a, c, t, g, unknown or other
  modified_base (1058)..(1069): a, c, t, g, unknown or other
  modified_base (1071)..(1075): a, c, t, g, unknown or other
  modified_base (1077)..(1077): a, c, t, g, unknown or other
  modified_base (1079)..(1079): a, c, t, g, unknown or other
  modified_base (1082)..(1083): a, c, t, g, unknown or other
  modified_base (1087)..(1088): a, c, t, g, unknown or other
  modified_base (1090)..(1090): a, c, t, g, unknown or other
  modified_base (1094)..(1095): a, c, t, g, unknown or other
  modified_base (1098)..(1100): a, c, t, g, unknown or other
  modified_base (1102)..(1102): a, c, t, g, unknown or other
  modified_base (1104)..(1109): a, c, t, g, unknown or other
  modified_base (1111)..(1112): a, c, t, g, unknown or other
  modified_base (1114)..(1114): a, c, t, g, unknown or other
  modified_base (1116)..(1117): a, c, t, g, unknown or other
  modified_base (1120)..(1124): a, c, t, g, unknown or other
  modified_base (1126)..(1127): a, c, t, g, unknown or other
  modified_base (1132)..(1132): a, c, t, g, unknown or other
  modified_base (1134)..(1134): a, c, t, g, unknown or other
  modified_base (1140)..(1142): a, c, t, g, unknown or other
  modified_base (1144)..(1144): a, c, t, g, unknown or other
  modified_base (1146)..(1146): a, c, t, g, unknown or other
  modified_base (1149)..(1149): a, c, t, g, unknown or other
  modified_base (1151)..(1151): a, c, t, g, unknown or other
  modified_base (1153)..(1156): a, c, t, g, unknown or other
  modified_base (1158)..(1162): a, c, t, g, unknown or other
  modified_base (1164)..(1170): a, c, t, g, unknown or other
  modified_base (1173)..(1180): a, c, t, g, unknown or other
  modified_base (1182)..(1186): a, c, t, g, unknown or other
  modified_base (1188)..(1196): a, c, t, g, unknown or other
  modified_base (1198)..(1205): a, c, t, g, unknown or other
  modified_base (1207)..(1207): a, c, t, g, unknown or other
  modified_base (1210)..(1211): a, c, t, g, unknown or other
  modified_base (1214)..(1235): a, c, t, g, unknown or other
  modified_base (1237)..(1238): a, c, t, g, unknown or other
  modified_base (1240)..(1241): a, c, t, g, unknown or other
nnnnnnnnttangnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttccaattcccaggctgtggtgacccaggagccctcactgactgtgtccccaggagggacagtcactctcacctgtggctccagcactggagctgtcaccagtggtcattatccctactggttccagcagaagtctggccaagcccccaggacactgatttatgaaacaagcatcaaacactcctggacccctgcccggttctcaggctccctccttgggggcaaagctgccctgaccctttcgggtgcgcagcctgaggatgaggctgattattactgcttgctctcctatagtggtgctcggccggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctanttgtggttnnnccaaactcatcaatgtatnnnatcatgtntggnncgggaatnannnnntnnnnncnncnnnnnnnnnnnnnnnnnnnnnnnannnnnnnnaannnannnannnnnnnnnnnncnnnnngnangcnnaaannancatnntgnnngnannnnnngnnantnnggnnnnnanntcccngntcccannngnanaantntnnnncnnnnntnnnnnnncannnnnnnngnnnnncnnnnnnnnngnnnnnnnnanagnnatnnnnnnnnnnnnnnnnnnnnnncnncnn

SEQ ID NO: 3584 - DNA, 331 bp, Artificial Sequence
  source: /note="Description of Artificial Sequence: Synthetic polynucleotide"
cagtctgtgctgactcaggagccctcactgactgtgtccccaggagggacagtcactctcacctgtggctccagcactggagctgtcaccagtggtcattatccctactggttccagcagaagtctggccaagcccccaggacactgatttatgaaacaagcatcaaacactcctggacccctgcccggttctcaggctccctccttgggggcaaagctgccctgaccctttcgggtgcgcagcctgaggatgaggctgattattactgcttgctctcctatagtggtgctcggccggtgttcggcggagggaccaagctgaccgtcctag

SEQ ID NO: 3585 - DNA, 1218 bp, Artificial Sequence
  source: /note="Description of Artificial Sequence: Synthetic polynucleotide"
  modified_base (1)..(11): a, c, t, g, unknown or other
  modified_base (14)..(14): a, c, t, g, unknown or other
  modified_base (18)..(18): a, c, t, g, unknown or other
  modified_base (850)..(858): a, c, t, g, unknown or other
  modified_base (865)..(867): a, c, t, g, unknown or other
  modified_base (870)..(873): a, c, t, g, unknown or other
  modified_base (875)..(875): a, c, t, g, unknown or other
  modified_base (877)..(881): a, c, t, g, unknown or other
  modified_base (883)..(884): a, c, t, g, unknown or other
  modified_base (886)..(886): a, c, t, g, unknown or other
  modified_base (892)..(892): a, c, t, g, unknown or other
  modified_base (895)..(900): a, c, t, g, unknown or other
  modified_base (902)..(902): a, c, t, g, unknown or other
  modified_base (904)..(904): a, c, t, g, unknown or other
  modified_base (909)..(910): a, c, t, g, unknown or other
  modified_base (912)..(912): a, c, t, g, unknown or other
  modified_base (921)..(921): a, c, t, g, unknown or other
  modified_base (924)..(924): a, c, t, g, unknown or other
  modified_base (928)..(931): a, c, t, g, unknown or other
  modified_base (934)..(942): a, c, t, g, unknown or other
  modified_base (945)..(947): a, c, t, g, unknown or other
  modified_base (949)..(950): a, c, t, g, unknown or other
  modified_base (952)..(952): a, c, t, g, unknown or other
  modified_base (956)..(960): a, c, t, g, unknown or other
  modified_base (962)..(966): a, c, t, g, unknown or other
  modified_base (969)..(969): a, c, t, g, unknown or other
  modified_base (971)..(971): a, c, t, g, unknown or other
  modified_base (973)..(973): a, c, t, g, unknown or other
  modified_base (975)..(976): a, c, t, g, unknown or other
  modified_base (980)..(984): a, c, t, g, unknown or other
  modified_base (986)..(986): a, c, t, g, unknown or other
  modified_base (988)..(989): a, c, t, g, unknown or other
  modified_base (991)..(991): a, c, t, g, unknown or other
  modified_base (997)..(998): a, c, t, g, unknown or other
  modified_base (1000)..(1000): a, c, t, g, unknown or other
  modified_base (1002)..(1003): a, c, t, g, unknown or other
  modified_base (1007)..(1012): a, c, t, g, unknown or other
  modified_base (1015)..(1021): a, c, t, g, unknown or other
  modified_base (1023)..(1029): a, c, t, g, unknown or other
  modified_base (1031)..(1036): a, c, t, g, unknown or other
  modified_base (1038)..(1038): a, c, t, g, unknown or other
  modified_base (1040)..(1040): a, c, t, g, unknown or other
  modified_base (1042)..(1046): a, c, t, g, unknown or other
  modified_base (1048)..(1048): a, c, t, g, unknown or other
  modified_base (1050)..(1054): a, c, t, g, unknown or other
  modified_base (1056)..(1056): a, c, t, g, unknown or other
  modified_base (1058)..(1061): a, c, t, g, unknown or other
  modified_base (1063)..(1063): a, c, t, g, unknown or other
  modified_base (1065)..(1069): a, c, t, g, unknown or other
  modified_base (1071)..(1071): a, c, t, g, unknown or other
  modified_base (1073)..(1079): a, c, t, g, unknown or other
  modified_base (1085)..(1088): a, c, t, g, unknown or other
  modified_base (1090)..(1090): a, c, t, g, unknown or other
  modified_base (1092)..(1092): a, c, t, g, unknown or other
  modified_base (1095)..(1095): a, c, t, g, unknown or other
  modified_base (1097)..(1101): a, c, t, g, unknown or other
  modified_base (1103)..(1105): a, c, t, g, unknown or other
  modified_base (1108)..(1112): a, c, t, g, unknown or other
  modified_base (1115)..(1118): a, c, t, g, unknown or other
  modified_base (1120)..(1122): a, c, t, g, unknown or other
  modified_base (1126)..(1128): a, c, t, g, unknown or other
  modified_base (1130)..(1130): a, c, t, g, unknown or other
  modified_base (1132)..(1132): a, c, t, g, unknown or other
  modified_base (1134)..(1134): a, c, t, g, unknown or other
  modified_base (1136)..(1136): a, c, t, g, unknown or other
  modified_base (1138)..(1138): a, c, t, g, unknown or other
  modified_base (1140)..(1146): a, c, t, g, unknown or other
  modified_base (1148)..(1152): a, c, t, g, unknown or other
  modified_base (1154)..(1159): a, c, t, g, unknown or other
  modified_base (1161)..(1166): a, c, t, g, unknown or other
  modified_base (1168)..(1171): a, c, t, g, unknown or other
  modified_base (1173)..(1173): a, c, t, g, unknown or other
  modified_base (1175)..(1176): a, c, t, g, unknown or other
  modified_base (1178)..(1187): a, c, t, g, unknown or other
  modified_base (1189)..(1197): a, c, t, g, unknown or other
  modified_base (1199)..(1208): a, c, t, g, unknown or other
  modified_base (1210)..(1210): a, c, t, g, unknown or other
  modified_base (1212)..(1212): a, c, t, g, unknown or other
  modified_base (1214)..(1218): a, c, t, g, unknown or other
nnnnnnnnnnntgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtccagcctggggggtcccagagactctcctgtgcagcctctggattcaccgtcagtagcaattacatgagctggatccgccaggctccagggaaggggctggagtgggtctcagttatttatagcggtggtagcgcatactacgtagactccgtgaagggcagattcaccatctccagagacaattccaagaacaccctgtatcttcaaatgaacagcctgagacccgaggacacggctgtgtattactgtgcgagaatcgcaaactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactnnnnnnnnncccccgnnnccnnnncncnnnnncnncngggggngannnnnnantnttctnntncccccaaanccnaggnnnnccnnnnnnnnnttnnncnngncccnnnnngnnnnntgngngngnngggnnnnngngnncnaaaaanncncnngagnnnnnnttnnnnnnngnnnnnnnannnnnngnangnnnnntnannnnnanannnncngnnnnnangnnnnnnnacaacnnnncntncgngnnnnngnnnctnnnnntcnnnncnnnactnnngnangnangnannnnnnnannnnnannnnnncnnnnnntnnnncntnnannnnnnnnnnannnnnnnnncnnnnnnnnnngngnannnnn

SEQ ID NO: 3586 - DNA, 345 bp, Artificial Sequence; identical to SEQ ID NO: 321
  source: /note="Description of Artificial Sequence: Synthetic polynucleotide"

SEQ ID NO: 3587 - DNA, 1167 bp, Artificial Sequence
  source: /note="Description of Artificial Sequence: Synthetic polynucleotide"
  modified_base (1)..(5): a, c, t, g, unknown or other
  modified_base (7)..(8): a, c, t, g, unknown or other
  modified_base (12)..(12): a, c, t, g, unknown or other
  modified_base (15)..(16): a, c, t, g, unknown or other
  modified_base (850)..(851): a, c, t, g, unknown or other
  modified_base (855)..(856): a, c, t, g, unknown or other
  modified_base (858)..(860): a, c, t, g, unknown or other
  modified_base (862)..(862): a, c, t, g, unknown or other
  modified_base (866)..(867): a, c, t, g, unknown or other
  modified_base (871)..(873): a, c, t, g, unknown or other
  modified_base (875)..(875): a, c, t, g, unknown or other
  modified_base (880)..(881): a, c, t, g, unknown or other
  modified_base (883)..(883): a, c, t, g, unknown or other
  modified_base (894)..(894): a, c, t, g, unknown or other
  modified_base (898)..(898): a, c, t, g, unknown or other
  modified_base (906)..(906): a, c, t, g, unknown or other
  modified_base (937)..(937): a, c, t, g, unknown or other
  modified_base (939)..(939): a, c, t, g, unknown or other
  modified_base (949)..(949): a, c, t, g, unknown or other
  modified_base (954)..(956): a, c, t, g, unknown or other
  modified_base (959)..(961): a, c, t, g, unknown or other
  modified_base (963)..(984): a, c, t, g, unknown or other
  modified_base (986)..(1005): a, c, t, g, unknown or other
  modified_base (1010)..(1010): a, c, t, g, unknown or other
  modified_base (1014)..(1015): a, c, t, g, unknown or other
  modified_base (1017)..(1019): a, c, t, g, unknown or other
  modified_base (1021)..(1021): a, c, t, g, unknown or other
  modified_base (1025)..(1025): a, c, t, g, unknown or other
  modified_base (1027)..(1028): a, c, t, g, unknown or other
  modified_base (1031)..(1034): a, c, t, g, unknown or other
  modified_base (1037)..(1047): a, c, t, g, unknown or other
  modified_base (1049)..(1051): a, c, t, g, unknown or other
  modified_base (1053)..(1055): a, c, t, g, unknown or other
  modified_base (1060)..(1061): a, c, t, g, unknown or other
  modified_base (1064)..(1065): a, c, t, g, unknown or other
  modified_base (1067)..(1067): a, c, t, g, unknown or other
  modified_base (1069)..(1079): a, c, t, g, unknown or other
  modified_base (1084)..(1084): a, c, t, g, unknown or other
  modified_base (1086)..(1087): a, c, t, g, unknown or other
  modified_base (1089)..(1090): a, c, t, g, unknown or other
  modified_base (1092)..(1101): a, c, t, g, unknown or other
  modified_base (1104)..(1107): a, c, t, g, unknown or other
  modified_base (1109)..(1111): a, c, t, g, unknown or other
  modified_base (1113)..(1115): a, c, t, g, unknown or other
  modified_base (1117)..(1118): a, c, t, g, unknown or other
  modified_base (1120)..(1120): a, c, t, g, unknown or other
  modified_base (1122)..(1122): a, c, t, g, unknown or other
  modified_base (1124)..(1126): a, c, t, g, unknown or other
  modified_base (1128)..(1128): a, c, t, g, unknown or other
  modified_base (1130)..(1133): a, c, t, g, unknown or other
  modified_base (1135)..(1146): a, c, t, g, unknown or other
  modified_base (1149)..(1154): a, c, t, g, unknown or other
  modified_base (1156)..(1156): a, c, t, g, unknown or other
  modified_base (1158)..(1158): a, c, t, g, unknown or other
  modified_base (1160)..(1161): a, c, t, g, unknown or other
  modified_base (1163)..(1163): a, c, t, g, unknown or other
  modified_base (1165)..(1165): a, c, t, g, unknown or other
  modified_base (1167)..(1167): a, c, t, g, unknown or other
nnnnncnnatgnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaatagtgatgacgcagtctccagccaccctgtctgtgtctccaggggaaagagccaccctctcctgcagggccagtcagagtgttagcagccacttagcctggtaccagcagaaacctggccaggctcccaggctcctcatctatggtgcatccaccagggccactggtatcccaaccaggttcagtggcagtgggtctgggacagagttcactctcaccatcagcagcctgcagtctgaagattttgcagtttattactgccagcagtataataactggcctccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggnnccanntnnntntatnncagnnnanaatgnntncaaataaagcnatancatcacanatttcacaaataaagcatttttttcactgcntnctagtgtggnttgtnnncannncnnnnnnnnnnnnnnnnnnnnnngnnnnnnnnnnnnnnnnnnnncgcancacnngnnntnaaantnnctnnnnaannnnnnnnnnngnnncnnngaggnnaannancnnnnnnnnnnngtcantnngnngnnnnnnnnnnccnnnngnnnannngnnancntnnntnannnncnnnnnnnnnnnnccnnnnnnangnanngnancn

SEQ ID NO: 3588 - DNA, 325 bp, Artificial Sequence; identical to SEQ ID NO: 322
  source: /note="Description of Artificial Sequence: Synthetic polynucleotide"

SEQ ID NO: 3589 - DNA, 1313 bp, Artificial Sequence
  source: /note="Description of Artificial Sequence: Synthetic polynucleotide"
  modified_base (1)..(18): a, c, t, g, unknown or other
  modified_base (21)..(21): a, c, t, g, unknown or other
  modified_base (912)..(913): a, c, t, g, unknown or other
  modified_base (954)..(956): a, c, t, g, unknown or other
  modified_base (972)..(973): a, c, t, g, unknown or other
  modified_base (1003)..(1004): a, c, t, g, unknown or other
  modified_base (1021)..(1021): a, c, t, g, unknown or other
  modified_base (1023)..(1023): a, c, t, g, unknown or other
  modified_base (1045)..(1045): a, c, t, g, unknown or other
  modified_base (1048)..(1048): a, c, t, g, unknown or other
  modified_base (1050)..(1051): a, c, t, g, unknown or other
  modified_base (1057)..(1058): a, c, t, g, unknown or other
  modified_base (1061)..(1061): a, c, t, g, unknown or other
  modified_base (1063)..(1063): a, c, t, g, unknown or other
  modified_base (1066)..(1067): a, c, t, g, unknown or other
  modified_base (1072)..(1072): a, c, t, g, unknown or other
  modified_base (1076)..(1077): a, c, t, g, unknown or other
  modified_base (1079)..(1089): a, c, t, g, unknown or other
  modified_base (1091)..(1093): a, c, t, g, unknown or other
  modified_base (1097)..(1097): a, c, t, g, unknown or other
  modified_base (1100)..(1100): a, c, t, g, unknown or other
  modified_base (1102)..(1102): a, c, t, g, unknown or other
  modified_base (1112)..(1112): a, c, t, g, unknown or other
  modified_base (1117)..(1118): a, c, t, g, unknown or other
  modified_base (1120)..(1120): a, c, t, g, unknown or other
  modified_base (1124)..(1125): a, c, t, g, unknown or other
  modified_base (1127)..(1127): a, c, t, g, unknown or other
  modified_base (1129)..(1129): a, c, t, g, unknown or other
  modified_base (1137)..(1137): a, c, t, g, unknown or other
  modified_base (1139)..(1139): a, c, t, g, unknown or other
  modified_base (1145)..(1145): a, c, t, g, unknown or other
  modified_base (1150)..(1150): a, c, t, g, unknown or other
  modified_base (1153)..(1154): a, c, t, g, unknown or other
  modified_base (1157)..(1159): a, c, t, g, unknown or other
  modified_base (1161)..(1161): a, c, t, g, unknown or other
  modified_base (1164)..(1165): a, c, t, g, unknown or other
  modified_base (1168)..(1168): a, c, t, g, unknown or other
  modified_base (1171)..(1172): a, c, t, g, unknown or other
  modified_base (1174)..(1175): a, c, t, g, unknown or other
  modified_base (1180)..(1182): a, c, t, g, unknown or other
  modified_base (1184)..(1184): a, c, t, g, unknown or other
  modified_base (1187)..(1187): a, c, t, g, unknown or other
  modified_base (1189)..(1189): a, c, t, g, unknown or other
  modified_base (1191)..(1191): a, c, t, g, unknown or other
  modified_base (1196)..(1198): a, c, t, g, unknown or other
  modified_base (1201)..(1202): a, c, t, g, unknown or other
  modified_base (1205)..(1206): a, c, t, g, unknown or other
  modified_base (1209)..(1209): a, c, t, g, unknown or other
  modified_base (1211)..(1211): a, c, t, g, unknown or other
  modified_base (1214)..(1216): a, c, t, g, unknown or other
  modified_base (1224)..(1225): a, c, t, g, unknown or other
  modified_base (1227)..(1227): a, c, t, g, unknown or other
  modified_base (1232)..(1233): a, c, t, g, unknown or other
  modified_base (1235)..(1236): a, c, t, g, unknown or other
  modified_base (1238)..(1250): a, c, t, g, unknown or other
  modified_base (1253)..(1255): a, c, t, g, unknown or other
  modified_base (1258)..(1258): a, c, t, g, unknown or other
  modified_base (1260)..(1261): a, c, t, g, unknown or other
  modified_base (1263)..(1266): a, c, t, g, unknown or other
  modified_base (1269)..(1273): a, c, t, g, unknown or other
  modified_base (1276)..(1276): a, c, t, g, unknown or other
  modified_base (1278)..(1279): a, c, t, g, unknown or other
  modified_base (1282)..(1289): a, c, t, g, unknown or other
  modified_base (1294)..(1294): a, c, t, g, unknown or other
  modified_base (1296)..(1301): a, c, t, g, unknown or other
  modified_base (1304)..(1305): a, c, t, g, unknown or other
  modified_base (1307)..(1313): a, c, t, g, unknown or other
nnnnnnnnnnnnnnnnnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtacctatggcatgcactgggtccgccaggctccaggcaaggggctggagtgggtggccgttatatcatatgatggaagtaataaatactttgcagactccgtgaagggccgattcaccatctccagagacaattccaagaacacgctttatctgcaaatgaacagcctgagacctgaggacacggctgtatattactgtgcgaaagtggggatggagtacagcagtggctggtacggggaagaaattgacttctggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctganntcctggggggaccgtcagtcttcctcttccccccaaaaccnnngacaccctcatgatcnnccggacccctgaggtcacatgcgtggtggnnggacgtgagccacgaanancctgaggtcaagttcaactggnacntnncggcgnnggnanggnncatanatgnncnnnnnnnnnnncnnngggnagnancagttacaancagcnncntacnngntngtggtcancntcctcncgtcngcnncannnantgnnttnaanngnnaggannncnagngnangggtnnncannaannccntnccnnnccccattnnanaaaanncnntnnnnnnnnnnnnnggnnnaancnncnnnnaannnnnggngnnacnnnnnnnnccccncnnnnnnccnngnnnnnnn

SEQ ID NO: 3590 - DNA, 376 bp, Artificial Sequence
  source: /note="Description of Artificial Sequence: Synthetic polynucleotide"
caggtgcagctggtggagtctgggggaggcgtggtccagcctgggaggtccctgagactctcctgtgcagcctctggattcaccttcagtacctatggcatgcactgggtccgccaggctccaggcaaggggctggagtgggtggccgttatatcatatgatggaagtaataaatactttgcagactccgtgaagggccgattcaccatctccagagacaattccaagaacacgctttatttgcaaatgaacagcctgagacctgaggacacggctgtatattactgtgcgaaagtggggatggagtacagcagtggctggtacggggaagaaattgacttctggggccagggaaccctggtcaccgtctcctcag

SEQ ID NO: 3591 - DNA, 1219 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (17)..(17): a, c, t, g, unknown or other
  modified_base (23)..(23): a, c, t, g, unknown or other
  modified_base (945)..(945): a, c, t, g, unknown or other
  modified_base (965)..(965): a, c, t, g, unknown or other
  modified_base (981)..(982): a, c, t, g, unknown or other
  modified_base (992)..(992): a, c, t, g, unknown or other
  modified_base (997)..(997): a, c, t, g, unknown or other
  modified_base (1005)..(1007): a, c, t, g, unknown or other
  modified_base (1009)..(1012): a, c, t, g, unknown or other
  modified_base (1016)..(1018): a, c, t, g, unknown or other
  modified_base (1020)..(1021): a, c, t, g, unknown or other
  modified_base (1028)..(1028): a, c, t, g, unknown or other
  modified_base (1031)..(1031): a, c, t, g, unknown or other
  modified_base (1035)..(1041): a, c, t, g, unknown or other
  modified_base (1044)..(1046): a, c, t, g, unknown or other
  modified_base (1050)..(1050): a, c, t, g, unknown or other
  modified_base (1054)..(1055): a, c, t, g, unknown or other
  modified_base (1058)..(1058): a, c, t, g, unknown or other
  modified_base (1063)..(1066): a, c, t, g, unknown or other
  modified_base (1068)..(1070): a, c, t, g, unknown or other
  modified_base (1075)..(1075): a, c, t, g, unknown or other
  modified_base (1077)..(1077): a, c, t, g, unknown or other
  modified_base (1080)..(1083): a, c, t, g, unknown or other
  modified_base (1094)..(1094): a, c, t, g, unknown or other
  modified_base (1099)..(1100): a, c, t, g, unknown or other
  modified_base (1102)..(1102): a, c, t, g, unknown or other
  modified_base (1104)..(1106): a, c, t, g, unknown or other
  modified_base (1109)..(1110): a, c, t, g, unknown or other
  modified_base (1117)..(1120): a, c, t, g, unknown or other
  modified_base (1124)..(1133): a, c, t, g, unknown or other
  modified_base (1136)..(1139): a, c, t, g, unknown or other
  modified_base (1141)..(1149): a, c, t, g, unknown or other
  modified_base (1151)..(1159): a, c, t, g, unknown or other
  modified_base (1161)..(1164): a, c, t, g, unknown or other
  modified_base (1166)..(1167): a, c, t, g, unknown or other
  modified_base (1171)..(1172): a, c, t, g, unknown or other
  modified_base (1175)..(1175): a, c, t, g, unknown or other
  modified_base (1177)..(1203): a, c, t, g, unknown or other
  modified_base (1205)..(1205): a, c, t, g, unknown or other
  modified_base (1209)..(1209): a, c, t, g, unknown or other
  modified_base (1211)..(1211): a, c, t, g, unknown or other
  modified_base (1213)..(1213): a, c, t, g, unknown or other
  modified_base (1215)..(1219): a, c, t, g, unknown or other
nnnnnnnnnatgnatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccgggtacattctgacatccagatgacccagtctccatcctccctgtctgcatctgtaggagacagagtcaccatcacttgccgggcaagtcagagcattagcagttatttaaattggtatcagcagaaaccagggaaagtccctaagctcctgatctatgctgcatccagtttgcaaagtggggtcccatcaaggttcagtggcagtggatctgggacagacttcactctcaccatcagcagtctgcaacctgaagattttgcaacttactactgtcaacagagttacagaaccccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctagttgtggnttgtccaaactcatcaatgnatcttatcatgtctgnntcgggaattnattcngcgcagcnnntnnnngaannnannctgaaanagnactnnnnnnnacnnngagngaannacntctgnnnngnnngtcantnggnnnngaagtcccagntcccnncngnnnaannatgcaannnngcannnnnnnnnncannnncnnnnnnnnnannnnnnnnncnnnngnnaaanntgnannnnnnnnnnnnnnnnnnnnnnnnnnncncccnantngnnnnn

SEQ ID NO: 3592 - DNA, 322 bp, Artificial Sequence; identical to SEQ ID NO: 324
  source: /note="Description of Artificial Sequence: Synthetic polynucleotide"

SEQ ID NO: 3593 - DNA, 1247 bp, Artificial Sequence
  source: /note="Description of Artificial Sequence: Synthetic polynucleotide"
  modified_base (1)..(10): a, c, t, g, unknown or other
  modified_base (14)..(14): a, c, t, g, unknown or other
  modified_base (17)..(18): a, c, t, g, unknown or other
  modified_base (22)..(22): a, c, t, g, unknown or other
  modified_base (844)..(844): a, c, t, g, unknown or other
  modified_base (919)..(919): a, c, t, g, unknown or other
  modified_base (930)..(931): a, c, t, g, unknown or other
  modified_base (941)..(941): a, c, t, g, unknown or other
  modified_base (947)..(948): a, c, t, g, unknown or other
  modified_base (952)..(954): a, c, t, g, unknown or other
  modified_base (957)..(958): a, c, t, g, unknown or other
  modified_base (962)..(963): a, c, t, g, unknown or other
  modified_base (966)..(966): a, c, t, g, unknown or other
  modified_base (968)..(970): a, c, t, g, unknown or other
  modified_base (973)..(973): a, c, t, g, unknown or other
  modified_base (978)..(982): a, c, t, g, unknown or other
  modified_base (985)..(986): a, c, t, g, unknown or other
  modified_base (989)..(991): a, c, t, g, unknown or other
  modified_base (993)..(994): a, c, t, g, unknown or other
  modified_base (996)..(1000): a, c, t, g, unknown or other
  modified_base (1003)..(1005): a, c, t, g, unknown or other
  modified_base (1012)..(1012): a, c, t, g, unknown or other
  modified_base (1016)..(1017): a, c, t, g, unknown or other
  modified_base (1019)..(1019): a, c, t, g, unknown or other
  modified_base (1022)..(1027): a, c, t, g, unknown or other
  modified_base (1031)..(1031): a, c, t, g, unknown or other
  modified_base (1033)..(1033): a, c, t, g, unknown or other
  modified_base (1038)..(1043): a, c, t, g, unknown or other
  modified_base (1045)..(1046): a, c, t, g, unknown or other
  modified_base (1048)..(1052): a, c, t, g, unknown or other
  modified_base (1054)..(1055): a, c, t, g, unknown or other
  modified_base (1057)..(1065): a, c, t, g, unknown or other
  modified_base (1067)..(1088): a, c, t, g, unknown or other
  modified_base (1090)..(1092): a, c, t, g, unknown or other
  modified_base (1094)..(1096): a, c, t, g, unknown or other
  modified_base (1098)..(1099): a, c, t, g, unknown or other
  modified_base (1101)..(1101): a, c, t, g, unknown or other
  modified_base (1103)..(1104): a, c, t, g, unknown or other
  modified_base (1107)..(1111): a, c, t, g, unknown or other
  modified_base (1114)..(1114): a, c, t, g, unknown or other
  modified_base (1116)..(1117): a, c, t, g, unknown or other
  modified_base (1120)..(1120): a, c, t, g, unknown or other
  modified_base (1122)..(1124): a, c, t, g, unknown or other
  modified_base (1126)..(1126): a, c, t, g, unknown or other
  modified_base (1128)..(1133): a, c, t, g, unknown or other
  modified_base (1136)..(1136): a, c, t, g, unknown or other
  modified_base (1138)..(1151): a, c, t, g, unknown or other
  modified_base (1154)..(1155): a, c, t, g, unknown or other
  modified_base (1158)..(1160): a, c, t, g, unknown or other
  modified_base (1162)..(1171): a, c, t, g, unknown or other
  modified_base (1173)..(1174): a, c, t, g, unknown or other
  modified_base (1176)..(1178): a, c, t, g, unknown or other
  modified_base (1180)..(1180): a, c, t, g, unknown or other
  modified_base (1183)..(1184): a, c, t, g, unknown or other
  modified_base (1186)..(1186): a, c, t, g, unknown or other
  modified_base (1188)..(1194): a, c, t, g, unknown or other
  modified_base (1196)..(1203): a, c, t, g, unknown or other
  modified_base (1205)..(1205): a, c, t, g, unknown or other
  modified_base (1207)..(1213): a, c, t, g, unknown or other
  modified_base (1215)..(1215): a, c, t, g, unknown or other
  modified_base (1220)..(1220): a, c, t, g, unknown or other
  modified_base (1222)..(1224): a, c, t, g, unknown or other
  modified_base (1227)..(1227): a, c, t, g, unknown or other
  modified_base (1229)..(1229): a, c, t, g, unknown or other
  modified_base (1231)..(1239): a, c, t, g, unknown or other
  modified_base (1241)..(1247): a, c, t, g, unknown or other
nnnnnnnnnnatgnatnntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtccgggggaggcttagttcagcctggggggtccctgagactctcctgtgtagcctctggattcaccttcagtagctactggatgcactgggtccgccaagtcccagggaaggggccggtgtgggtctcacatattaacagtgaagggagtagcacaaactacgcggactccgtgaggggccgattcaccatctccagagacaacgccaaggacacgctatatcttcaaatgaacaatctgagagccgaggacacggctgtatattactgtgcaagaccgacggctgtagcagcagctggcaattacttctactactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnaagtggacaagagagttgagcccaaatcttgtgacaaaactcacacatgcccaccgtgcccagcacctgaactcntgggggggacnntcagtcttcntcttcnncccnnnaanncaannganannntcntgatnnnnnctnnccnnngnngnnnnntgnnntggtggngggnngngannnnnnaacnanccaannnnnncnngnnnnnanntnnnnnnnnngnnnnnnnnnnnnnnnnnnnnnncnnnannncnnanannaannnnnggnannaanannncnannnnnngtncnnnnnnnnnnnnnnctnnccnnncnnnnnnnnnnanngnnnanggnnangnnnnnnnannnnnnnnanannnnnnnancatgnannnttnancnnnnnnnnncnnnnnnn

SEQ ID NO: 3594 - DNA, 381 bp, Artificial Sequence
  source: /note="Description of Artificial Sequence: Synthetic polynucleotide"
gaggtgcagctggtggagtccgggggaggcttagttcagcctggggggtccctgagactctcctgtgtagcctctggattcaccttcagtagctactggatgcactgggtccgccaagtcccagggaaggggccggtgtgggtctcacatattaacagtgaagggagtagcacaaactacgcggactccgtgaggggccgattcaccatctccagagacaacgccaaggacacgctatatcttcaaatgaacaatctgagagccgaggacacggctgtatattactgtgcaagaccgacggctgtagcagcagctggcaattacttctactactacggtatggacgtctggggccaagggaccacggtcaccgtctcttca

SEQ ID NO: 3595 - DNA, 1176 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (17)..(17): a, c, t, g, unknown or other
  modified_base (855)..(855): a, c, t, g, unknown or other
  modified_base (860)..(861): a, c, t, g, unknown or other
  modified_base (866)..(866): a, c, t, g, unknown or other
  modified_base (869)..(871): a, c, t, g, unknown or other
  modified_base (875)..(876): a, c, t, g, unknown or other
  modified_base (886)..(886): a, c, t, g, unknown or other
  modified_base (890)..(890): a, c, t, g, unknown or other
  modified_base (910)..(910): a, c, t, g, unknown or other
  modified_base (912)..(912): a, c, t, g, unknown or other
  modified_base (948)..(948): a, c, t, g, unknown or other
  modified_base (954)..(955): a, c, t, g, unknown or other
  modified_base (961)..(961): a, c, t, g, unknown or other
  modified_base (976)..(976): a, c, t, g, unknown or other
  modified_base (978)..(978): a, c, t, g, unknown or other
  modified_base (984)..(984): a, c, t, g, unknown or other
  modified_base (989)..(989): a, c, t, g, unknown or other
  modified_base (994)..(994): a, c, t, g, unknown or other
  modified_base (996)..(996): a, c, t, g, unknown or other
  modified_base (1000)..(1003): a, c, t, g, unknown or other
  modified_base (1009)..(1009): a, c, t, g, unknown or other
  modified_base (1014)..(1014): a, c, t, g, unknown or other
  modified_base (1018)..(1024): a, c, t, g, unknown or other
  modified_base (1026)..(1027): a, c, t, g, unknown or other
  modified_base (1029)..(1030): a, c, t, g, unknown or other
  modified_base (1032)..(1032): a, c, t, g, unknown or other
  modified_base (1034)..(1039): a, c, t, g, unknown or other
  modified_base (1046)..(1050): a, c, t, g, unknown or other
  modified_base (1053)..(1057): a, c, t, g, unknown or other
  modified_base (1059)..(1061): a, c, t, g, unknown or other
  modified_base (1064)..(1064): a, c, t, g, unknown or other
  modified_base (1067)..(1067): a, c, t, g, unknown or other
  modified_base (1069)..(1070): a, c, t, g, unknown or other
  modified_base (1072)..(1075): a, c, t, g, unknown or other
  modified_base (1077)..(1077): a, c, t, g, unknown or other
  modified_base (1080)..(1080): a, c, t, g, unknown or other
  modified_base (1082)..(1085): a, c, t, g, unknown or other
  modified_base (1087)..(1091): a, c, t, g, unknown or other
  modified_base (1093)..(1095): a, c, t, g, unknown or other
  modified_base (1097)..(1098): a, c, t, g, unknown or other
  modified_base (1100)..(1103): a, c, t, g, unknown or other
  modified_base (1105)..(1113): a, c, t, g, unknown or other
  modified_base (1115)..(1117): a, c, t, g, unknown or other
  modified_base (1119)..(1119): a, c, t, g, unknown or other
  modified_base (1121)..(1121): a, c, t, g, unknown or other
  modified_base (1123)..(1147): a, c, t, g, unknown or other
  modified_base (1149)..(1151): a, c, t, g, unknown or other
  modified_base (1153)..(1153): a, c, t, g, unknown or other
  modified_base (1156)..(1160): a, c, t, g, unknown or other
  modified_base (1162)..(1166): a, c, t, g, unknown or other
  modified_base (1169)..(1176): a, c, t, g, unknown or other
nnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacgttggttattataactttgtctcctggtaccaacaacacccaggcaaagcccccaaactcatgatttatgaggtcagtaatcggccctctggggtttctaatcgcttctctggctccaagtctggcaacacggcctccctgatcatctctgggctccaggctgaggacgaggctgattattactgcagctcatatagaagcagcagcactctggtgttcggcggggggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcncaacnngtttnttnnngctnnttatgatggntacnaataaagcaatagcatcacnantttcacaaataaagcatttttttcactgcattctanttgtgnntgtccnaactcatcatgtatntntcatgnctggntcggnantaannnngcagcncatgnctgnnnnnnncnnannanannnnnngtactcnnnnngannnnncnnngangangnngnnnntnggngnnnnannnnncnnncnncnnnngnnnnnnnnncnnncntncnnnnnnnnnnnnnnnnnnnnnnnnncnnngnccnnnnngnnnnntgnnnnnnnn

SEQ ID NO: 3596 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcagtgacgttggttattataactttgtctcctggtaccaacaacacccaggcaaagcccccaaactcatgatttatgaggtcagtaatcggccctctggggtttctaatcgcttctctggctccaagtctggcaacacggcctccctgatcatctctgggctccaggctgaggacgaggctgattattactgcagctcatatagaagcagcagcactctggtgttcggcggggggaccaagctgaccgtcctag

SEQ ID NO: 3597 - DNA, 1252 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (13)..(13): a, c, t, g, unknown or other
  modified_base (17)..(17): a, c, t, g, unknown or other
  modified_base (828)..(828): a, c, t, g, unknown or other
  modified_base (830)..(831): a, c, t, g, unknown or other
  modified_base (891)..(891): a, c, t, g, unknown or other
  modified_base (898)..(898): a, c, t, g, unknown or other
  modified_base (900)..(900): a, c, t, g, unknown or other
  modified_base (903)..(906): a, c, t, g, unknown or other
  modified_base (916)..(918): a, c, t, g, unknown or other
  modified_base (924)..(924): a, c, t, g, unknown or other
  modified_base (927)..(927): a, c, t, g, unknown or other
  modified_base (930)..(931): a, c, t, g, unknown or other
  modified_base (934)..(935): a, c, t, g, unknown or other
  modified_base (939)..(940): a, c, t, g, unknown or other
  modified_base (943)..(943): a, c, t, g, unknown or other
  modified_base (947)..(950): a, c, t, g, unknown or other
  modified_base (955)..(958): a, c, t, g, unknown or other
  modified_base (960)..(960): a, c, t, g, unknown or other
  modified_base (962)..(963): a, c, t, g, unknown or other
  modified_base (965)..(966): a, c, t, g, unknown or other
  modified_base (969)..(970): a, c, t, g, unknown or other
  modified_base (979)..(980): a, c, t, g, unknown or other
  modified_base (984)..(984): a, c, t, g, unknown or other
  modified_base (986)..(986): a, c, t, g, unknown or other
  modified_base (988)..(989): a, c, t, g, unknown or other
  modified_base (991)..(992): a, c, t, g, unknown or other
  modified_base (995)..(995): a, c, t, g, unknown or other
  modified_base (1004)..(1004): a, c, t, g, unknown or other
  modified_base (1007)..(1010): a, c, t, g, unknown or other
  modified_base (1013)..(1016): a, c, t, g, unknown or other
  modified_base (1019)..(1019): a, c, t, g, unknown or other
  modified_base (1022)..(1023): a, c, t, g, unknown or other
  modified_base (1027)..(1027): a, c, t, g, unknown or other
  modified_base (1029)..(1029): a, c, t, g, unknown or other
  modified_base (1047)..(1047): a, c, t, g, unknown or other
  modified_base (1054)..(1054): a, c, t, g, unknown or other
  modified_base (1058)..(1059): a, c, t, g, unknown or other
  modified_base (1061)..(1064): a, c, t, g, unknown or other
  modified_base (1068)..(1073): a, c, t, g, unknown or other
  modified_base (1077)..(1077): a, c, t, g, unknown or other
  modified_base (1080)..(1081): a, c, t, g, unknown or other
  modified_base (1089)..(1089): a, c, t, g, unknown or other
  modified_base (1093)..(1093): a, c, t, g, unknown or other
  modified_base (1095)..(1099): a, c, t, g, unknown or other
  modified_base (1102)..(1102): a, c, t, g, unknown or other
  modified_base (1104)..(1104): a, c, t, g, unknown or other
  modified_base (1110)..(1111): a, c, t, g, unknown or other
  modified_base (1116)..(1117): a, c, t, g, unknown or other
  modified_base (1119)..(1119): a, c, t, g, unknown or other
  modified_base (1121)..(1125): a, c, t, g, unknown or other
  modified_base (1127)..(1128): a, c, t, g, unknown or other
  modified_base (1130)..(1130): a, c, t, g, unknown or other
  modified_base (1133)..(1133): a, c, t, g, unknown or other
  modified_base (1139)..(1139): a, c, t, g, unknown or other
  modified_base (1141)..(1147): a, c, t, g, unknown or other
  modified_base (1149)..(1152): a, c, t, g, unknown or other
  modified_base (1154)..(1155): a, c, t, g, unknown or other
  modified_base (1157)..(1157): a, c, t, g, unknown or other
  modified_base (1159)..(1163): a, c, t, g, unknown or other
  modified_base (1165)..(1176): a, c, t, g, unknown or other
  modified_base (1178)..(1178): a, c, t, g, unknown or other
  modified_base (1180)..(1180): a, c, t, g, unknown or other
  modified_base (1182)..(1182): a, c, t, g, unknown or other
  modified_base (1184)..(1184): a, c, t, g, unknown or other
  modified_base (1186)..(1189): a, c, t, g, unknown or other
  modified_base (1192)..(1194): a, c, t, g, unknown or other
  modified_base (1196)..(1198): a, c, t, g, unknown or other
  modified_base (1201)..(1203): a, c, t, g, unknown or other
  modified_base (1207)..(1209): a, c, t, g, unknown or other
  modified_base (1212)..(1218): a, c, t, g, unknown or other
  modified_base (1220)..(1223): a, c, t, g, unknown or other
  modified_base (1225)..(1231): a, c, t, g, unknown or other
  modified_base (1234)..(1237): a, c, t, g, unknown or other
  modified_base (1239)..(1242): a, c, t, g, unknown or other
  modified_base (1246)..(1246): a, c, t, g, unknown or other
  modified_base (1248)..(1248): a, c, t, g, unknown or other
  modified_base (1250)..(1252): a, c, t, g, unknown or other
nnnnnncnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatgcattagtagtagtagtagttacatatactacgcagactcagtgaagggccgattcaccatctccagagacaacgccaagaactcactgtatctgcaaatgaacagcctgagagccgaggacacggctgtgtattactgtgcgagagagagggggtatgacggtggtaaaacccccccatttcttgggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnanntggacaagagagttgagccccaatcttgtgacaaaactcacacatgcccaccgtgcccancacctgnantcnnnngggggagggnnngtcttnttnttnntcnncccnnccnaaannnnaggannnncntnntnnttnncccggaccnntgangntnncnnggngtggggggnggnnnntgnnnnacnaanncccngnaggtcaagttcaactggnacgtggncggnntnnnntgcnnnnnncaanaannaagccgcnggangnnnnntananagcacnnaccgnngngnnnnncnncntcnccgtcngnnnnnnntnnnnanngnannnnnannnnnnnnnnnnanancntncnnnnccnnngnnnacnnncaannncannnnnnncnnnnannnnnnntannnncnnnncccncncnnn

SEQ ID NO: 3598 - DNA, 367 bp, Artificial Sequence; identical to SEQ ID NO: 327
  source: /note="Description of Artificial Sequence: Synthetic polynucleotide"

SEQ ID NO: 3599 - DNA, 1251 bp, Artificial Sequence
  source: /note="Description of Artificial Sequence: Synthetic polynucleotide"
  modified_base (1)..(11): a, c, t, g, unknown or other
  modified_base (15)..(15): a, c, t, g, unknown or other
  modified_base (19)..(19): a, c, t, g, unknown or other
  modified_base (23)..(23): a, c, t, g, unknown or other
  modified_base (862)..(862): a, c, t, g, unknown or other
  modified_base (866)..(866): a, c, t, g, unknown or other
  modified_base (871)..(871): a, c, t, g, unknown or other
  modified_base (876)..(876): a, c, t, g, unknown or other
  modified_base (880)..(880): a, c, t, g, unknown or other
  modified_base (887)..(887): a, c, t, g, unknown or other
  modified_base (894)..(895): a, c, t, g, unknown or other
  modified_base (916)..(917): a, c, t, g, unknown or other
  modified_base (938)..(938): a, c, t, g, unknown or other
  modified_base (943)..(944): a, c, t, g, unknown or other
  modified_base (948)..(949): a, c, t, g, unknown or other
  modified_base (954)..(958): a, c, t, g, unknown or other
  modified_base (961)..(961): a, c, t, g, unknown or other
  modified_base (967)..(968): a, c, t, g, unknown or other
  modified_base (973)..(973): a, c, t, g, unknown or other
  modified_base (985)..(986): a, c, t, g, unknown or other
  modified_base (992)..(992): a, c, t, g, unknown or other
  modified_base (994)..(994): a, c, t, g, unknown or other
  modified_base (997)..(997): a, c, t, g, unknown or other
  modified_base (1001)..(1001): a, c, t, g, unknown or other
  modified_base (1009)..(1009): a, c, t, g, unknown or other
  modified_base (1012)..(1013): a, c, t, g, unknown or other
  modified_base (1015)..(1015): a, c, t, g, unknown or other
  modified_base (1017)..(1018): a, c, t, g, unknown or other
  modified_base (1020)..(1020): a, c, t, g, unknown or other
  modified_base (1022)..(1022): a, c, t, g, unknown or other
  modified_base (1025)..(1034): a, c, t, g, unknown or other
  modified_base (1037)..(1042): a, c, t, g, unknown or other
  modified_base (1044)..(1044): a, c, t, g, unknown or other
  modified_base (1046)..(1051): a, c, t, g, unknown or other
  modified_base (1053)..(1053): a, c, t, g, unknown or other
  modified_base (1058)..(1067): a, c, t, g, unknown or other
  modified_base (1069)..(1074): a, c, t, g, unknown or other
  modified_base (1076)..(1077): a, c, t, g, unknown or other
  modified_base (1079)..(1081): a, c, t, g, unknown or other
  modified_base (1084)..(1084): a, c, t, g, unknown or other
  modified_base (1086)..(1089): a, c, t, g, unknown or other
  modified_base (1091)..(1091): a, c, t, g, unknown or other
  modified_base (1094)..(1097): a, c, t, g, unknown or other
  modified_base (1101)..(1102): a, c, t, g, unknown or other
  modified_base (1105)..(1105): a, c, t, g, unknown or other
  modified_base (1108)..(1108): a, c, t, g, unknown or other
  modified_base (1115)..(1115): a, c, t, g, unknown or other
  modified_base (1117)..(1118): a, c, t, g, unknown or other
  modified_base (1120)..(1126): a, c, t, g, unknown or other
  modified_base (1128)..(1130): a, c, t, g, unknown or other
  modified_base (1132)..(1139): a, c, t, g, unknown or other
  modified_base (1142)..(1145): a, c, t, g, unknown or other
  modified_base (1147)..(1149): a, c, t, g, unknown or other
  modified_base (1153)..(1158): a, c, t, g, unknown or other
  modified_base (1160)..(1160): a, c, t, g, unknown or other
  modified_base (1163)..(1170): a, c, t, g, unknown or other
  modified_base (1172)..(1184): a, c, t, g, unknown or other
  modified_base (1186)..(1187): a, c, t, g, unknown or other
  modified_base (1190)..(1190): a, c, t, g, unknown or other
  modified_base (1192)..(1201): a, c, t, g, unknown or other
  modified_base (1203)..(1207): a, c, t, g, unknown or other
  modified_base (1209)..(1209): a, c, t, g, unknown or other
  modified_base (1211)..(1217): a, c, t, g, unknown or other
  modified_base (1219)..(1219): a, c, t, g, unknown or other
  modified_base (1221)..(1228): a, c, t, g, unknown or other
  modified_base (1230)..(1233): a, c, t, g, unknown or other
  modified_base (1235)..(1238): a, c, t, g, unknown or other
  modified_base (1240)..(1251): a, c, t, g, unknown or other
nnnnnnnnnnnatgnatcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcttgggccaattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattattgggtgttcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccnactngttgnttatngcancttatgntggttannaataaagcaatatcatcacanntttcacaaataaagcattttntttcnntgcnntctannnnnggnttgtcnnactcntcaatgtatctnntcatgncnggntcgngaattaantcnncncnncncntgnnnnnnnnnnaannnnnngnannnnnnangtagnnnnnnnnnncnnnnnngnngnnnacnannnncngannnnggtnngtnagntaggggngnngnnnnnnncnnncnnnnnnnnagnnnnannnatgnnnnnntncannnnnnnncnnnnnnnnnnnnnannccnannnnnnnnnngnnnnngnannnnnnnantnnnnnnnnannnntnnnncnnnnnnnnnnnn

SEQ ID NO: 3600 - DNA, 334 bp, Artificial Sequence; identical to SEQ ID NO: 328
  source: /note="Description of Artificial Sequence: Synthetic polynucleotide"

SEQ ID NO: 3601 - DNA, 1202 bp, Artificial Sequence
  source: /note="Description of Artificial Sequence: Synthetic polynucleotide"
  modified_base (1)..(9): a, c, t, g, unknown or other
  modified_base (12)..(12): a, c, t, g, unknown or other
  modified_base (16)..(16): a, c, t, g, unknown or other
  modified_base (703)..(703): a, c, t, g, unknown or other
  modified_base (754)..(754): a, c, t, g, unknown or other
  modified_base (791)..(791): a, c, t, g, unknown or other
  modified_base (794)..(799): a, c, t, g, unknown or other
  modified_base (805)..(805): a, c, t, g, unknown or other
  modified_base (807)..(807): a, c, t, g, unknown or other
  modified_base (809)..(810): a, c, t, g, unknown or other
  modified_base (814)..(815): a, c, t, g, unknown or other
  modified_base (819)..(819): a, c, t, g, unknown or other
  modified_base (824)..(825): a, c, t, g, unknown or other
  modified_base (827)..(827): a, c, t, g, unknown or other
  modified_base (829)..(829): a, c, t, g, unknown or other
  modified_base (833)..(833): a, c, t, g, unknown or other
  modified_base (840)..(840): a, c, t, g, unknown or other
  modified_base (846)..(846): a, c, t, g, unknown or other
  modified_base (853)..(855): a, c, t, g, unknown or other
  modified_base (857)..(860): a, c, t, g, unknown or other
  modified_base (865)..(865): a, c, t, g, unknown or other
  modified_base (887)..(887): a, c, t, g, unknown or other
  modified_base (925)..(925): a, c, t, g, unknown or other
  modified_base (944)..(945): a, c, t, g, unknown or other
  modified_base (952)..(954): a, c, t, g, unknown or other
  modified_base (957)..(961): a, c, t, g, unknown or other
  modified_base (988)..(989): a, c, t, g, unknown or other
  modified_base (996)..(996): a, c, t, g, unknown or other
  modified_base (998)..(998): a, c, t, g, unknown or other
  modified_base (1000)..(1000): a, c, t, g, unknown or other
  modified_base (1006)..(1006): a, c, t, g, unknown or other
  modified_base (1008)..(1008): a, c, t, g, unknown or other
  modified_base (1010)..(1010): a, c, t, g, unknown or other
  modified_base (1012)..(1012): a, c, t, g, unknown or other
  modified_base (1014)..(1014): a, c, t, g, unknown or other
  modified_base (1016)..(1016): a, c, t, g, unknown or other
  modified_base (1020)..(1020): a, c, t, g, unknown or other
  modified_base (1022)..(1022): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1038)..(1039): a, c, t, g, unknown or other
  modified_base (1042)..(1047): a, c, t, g, unknown or other
  modified_base (1049)..(1050): a, c, t, g, unknown or other
  modified_base (1052)..(1052): a, c, t, g, unknown or other
  modified_base (1055)..(1056): a, c, t, g, unknown or other
  modified_base (1059)..(1059): a, c, t, g, unknown or other
  modified_base (1061)..(1062): a, c, t, g, unknown or other
  modified_base (1064)..(1064): a, c, t, g, unknown or other
  modified_base (1066)..(1068): a, c, t, g, unknown or other
  modified_base (1073)..(1075): a, c, t, g, unknown or other
  modified_base (1077)..(1077): a, c, t, g, unknown or other
  modified_base (1079)..(1080): a, c, t, g, unknown or other
  modified_base (1082)..(1087): a, c, t, g, unknown or other
  modified_base (1089)..(1091): a, c, t, g, unknown or other
  modified_base (1093)..(1097): a, c, t, g, unknown or other
  modified_base (1099)..(1100): a, c, t, g, unknown or other
  modified_base (1102)..(1102): a, c, t, g, unknown or other
  modified_base (1104)..(1105): a, c, t, g, unknown or other
  modified_base (1107)..(1109): a, c, t, g, unknown or other
  modified_base (1111)..(1113): a, c, t, g, unknown or other
  modified_base (1115)..(1124): a, c, t, g, unknown or other
  modified_base (1127)..(1130): a, c, t, g, unknown or other
  modified_base (1132)..(1157): a, c, t, g, unknown or other
  modified_base (1159)..(1176): a, c, t, g, unknown or other
  modified_base (1178)..(1178): a, c, t, g, unknown or other
  modified_base (1180)..(1181): a, c, t, g, unknown or other
  modified_base (1184)..(1184): a, c, t, g, unknown or other
  modified_base (1186)..(1188): a, c, t, g, unknown or other
  modified_base (1192)..(1194): a, c, t, g, unknown or other
  modified_base (1196)..(1196): a, c, t, g, unknown or other
  modified_base (1198)..(1201): a, c, t, g, unknown or other
nnnnnnnnntgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggttcagctgtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgttttactgtgcgagagatcggggggggcacgatttttggagtggttatgggttctactactactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcangcgccctgaccagcggcgtgcacaccttcccggctgtcctacagtcctcangactctactccctcagcagcgtggtgaccgtgccctnccnnnnnnttgggncncnnacanntatntgtgnnangngaantcacaanccccancaacacnnngnnnnaaganagttgagcccaaatcttgtganaaactcacacatgcccaccgtgcccagcacctgactcnggggggacgtcagtcttcnntcccccnnnccnnnnnccctcatgatctccgaccctgagtcanntgcgtgngngncgtgancncnanancntgangncagtcantgnacntgnnggnnnnnngnncntanncanannancnnnggagnnnantnnannnnnngnnncnnnnngnnancnncnnncnnncnnnnnnnnnntgnnnnannnnnnnnnnnnnnnnnnnnnnnnnnannnnnnnnnnnnnnnnnncntnnaancnnngggnnncncnnnna

SEQ ID NO: 3602 - DNA, 390 bp, Artificial Sequence; identical to SEQ ID NO: 329
  source: /note="Description of Artificial Sequence: Synthetic polynucleotide"

SEQ ID NO: 3603 - DNA, 1194 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (16)..(17): a, c, t, g, unknown or other
  modified_base (878)..(878): a, c, t, g, unknown or other
  modified_base (970)..(970): a, c, t, g, unknown or other
  modified_base (972)..(972): a, c, t, g, unknown or other
  modified_base (988)..(988): a, c, t, g, unknown or other
  modified_base (990)..(990): a, c, t, g, unknown or other
  modified_base (992)..(992): a, c, t, g, unknown or other
  modified_base (994)..(994): a, c, t, g, unknown or other
  modified_base (996)..(996): a, c, t, g, unknown or other
  modified_base (998)..(998): a, c, t, g, unknown or other
  modified_base (1003)..(1004): a, c, t, g, unknown or other
  modified_base (1006)..(1006): a, c, t, g, unknown or other
  modified_base (1008)..(1010): a, c, t, g, unknown or other
  modified_base (1016)..(1016): a, c, t, g, unknown or other
  modified_base (1019)..(1019): a, c, t, g, unknown or other
  modified_base (1025)..(1025): a, c, t, g, unknown or other
  modified_base (1028)..(1030): a, c, t, g, unknown or other
  modified_base (1032)..(1037): a, c, t, g, unknown or other
  modified_base (1043)..(1043): a, c, t, g, unknown or other
  modified_base (1049)..(1049): a, c, t, g, unknown or other
  modified_base (1051)..(1051): a, c, t, g, unknown or other
  modified_base (1055)..(1058): a, c, t, g, unknown or other
  modified_base (1060)..(1062): a, c, t, g, unknown or other
  modified_base (1065)..(1069): a, c, t, g, unknown or other
  modified_base (1074)..(1079): a, c, t, g, unknown or other
  modified_base (1082)..(1082): a, c, t, g, unknown or other
  modified_base (1084)..(1084): a, c, t, g, unknown or other
  modified_base (1086)..(1089): a, c, t, g, unknown or other
  modified_base (1092)..(1094): a, c, t, g, unknown or other
  modified_base (1097)..(1099): a, c, t, g, unknown or other
  modified_base (1101)..(1102): a, c, t, g, unknown or other
  modified_base (1104)..(1104): a, c, t, g, unknown or other
  modified_base (1106)..(1108): a, c, t, g, unknown or other
  modified_base (1110)..(1116): a, c, t, g, unknown or other
  modified_base (1124)..(1124): a, c, t, g, unknown or other
  modified_base (1126)..(1126): a, c, t, g, unknown or other
  modified_base (1128)..(1143): a, c, t, g, unknown or other
  modified_base (1145)..(1145): a, c, t, g, unknown or other
  modified_base (1148)..(1150): a, c, t, g, unknown or other
  modified_base (1153)..(1155): a, c, t, g, unknown or other
  modified_base (1157)..(1163): a, c, t, g, unknown or other
  modified_base (1165)..(1175): a, c, t, g, unknown or other
  modified_base (1178)..(1178): a, c, t, g, unknown or other
  modified_base (1180)..(1185): a, c, t, g, unknown or other
  modified_base (1187)..(1192): a, c, t, g, unknown or other
  modified_base (1194)..(1194): a, c, t, g, unknown or other
nnnnnnnnnatgnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccgggcgagtcagggcataagcaattacttagcctggtatcagcagagaccagggaaagttcctaagctcctgatctttgctgcatccactttgcaatcaggggtcccatctcggttcagtggcagtggatctgggacagatttcactctcaccatcagcagcctgcagcctgaagatgttgcaacttattactgtcaaaagtataacagtgcccctcggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacagggggagagtgttagaagcttggccgccatggcccaacttgtttattgcagcttataatggntacaaataaagcaatagcatcacaaatttcacaaataaagcatttttttcactgcattctagttgtggtttgtccaaactcatcaatgtatntntcatgtctggatcggnantnantngngcagnncntnnntgaaanacnctgaanagnnntnnnnnngtactnctgagngnagannnncnnngannnnngtcannnnnnggngnannnnccnnngcnnncnncngnnnannnnnnnagcatgcntncnnnnnnnnnnnnnnnngnagnnnacnnncnnnnnnngnnnnnnnnnnngcnannnnnncnnnnnntn

SEQ ID NO: 3604 - DNA, 322 bp, Artificial Sequence; identical to SEQ ID NO: 330
  source: /note="Description of Artificial Sequence: Synthetic polynucleotide"

SEQ ID NO: 3605 - DNA, 1247 bp, Artificial Sequence
  source: /note="Description of Artificial Sequence: Synthetic polynucleotide"
  modified_base (1)..(8): a, c, t, g, unknown or other
  modified_base (18)..(18): a, c, t, g, unknown or other
  modified_base (945)..(945): a, c, t, g, unknown or other
  modified_base (975)..(976): a, c, t, g, unknown or other
  modified_base (991)..(991): a, c, t, g, unknown or other
  modified_base (1015)..(1016): a, c, t, g, unknown or other
  modified_base (1025)..(1025): a, c, t, g, unknown or other
  modified_base (1032)..(1032): a, c, t, g, unknown or other
  modified_base (1036)..(1038): a, c, t, g, unknown or other
  modified_base (1041)..(1041): a, c, t, g, unknown or other
  modified_base (1044)..(1046): a, c, t, g, unknown or other
  modified_base (1055)..(1055): a, c, t, g, unknown or other
  modified_base (1057)..(1059): a, c, t, g, unknown or other
  modified_base (1061)..(1062): a, c, t, g, unknown or other
  modified_base (1064)..(1065): a, c, t, g, unknown or other
  modified_base (1067)..(1071): a, c, t, g, unknown or other
  modified_base (1075)..(1077): a, c, t, g, unknown or other
  modified_base (1080)..(1084): a, c, t, g, unknown or other
  modified_base (1086)..(1087): a, c, t, g, unknown or other
  modified_base (1089)..(1090): a, c, t, g, unknown or other
  modified_base (1093)..(1093): a, c, t, g, unknown or other
  modified_base (1095)..(1095): a, c, t, g, unknown or other
  modified_base (1098)..(1104): a, c, t, g, unknown or other
  modified_base (1106)..(1106): a, c, t, g, unknown or other
  modified_base (1110)..(1112): a, c, t, g, unknown or other
  modified_base (1114)..(1115): a, c, t, g, unknown or other
  modified_base (1117)..(1121): a, c, t, g, unknown or other
  modified_base (1123)..(1123): a, c, t, g, unknown or other
  modified_base (1125)..(1125): a, c, t, g, unknown or other
  modified_base (1127)..(1130): a, c, t, g, unknown or other
  modified_base (1133)..(1139): a, c, t, g, unknown or other
  modified_base (1141)..(1143): a, c, t, g, unknown or other
  modified_base (1147)..(1150): a, c, t, g, unknown or other
  modified_base (1152)..(1153): a, c, t, g, unknown or other
  modified_base (1156)..(1156): a, c, t, g, unknown or other
  modified_base (1158)..(1170): a, c, t, g, unknown or other
  modified_base (1172)..(1173): a, c, t, g, unknown or other
  modified_base (1176)..(1177): a, c, t, g, unknown or other
  modified_base (1179)..(1184): a, c, t, g, unknown or other
  modified_base (1186)..(1195): a, c, t, g, unknown or other
  modified_base (1197)..(1204): a, c, t, g, unknown or other
  modified_base (1206)..(1226): a, c, t, g, unknown or other
  modified_base (1230)..(1230): a, c, t, g, unknown or other
  modified_base (1232)..(1236): a, c, t, g, unknown or other
  modified_base (1239)..(1243): a, c, t, g, unknown or other
  modified_base (1247)..(1247): a, c, t, g, unknown or other
nnnnnnnnttatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcaccgtcagtagcaactacatgagctgggtccgccaggctccagggaaggggctggagtgggcctcagttatttatagcggttatagcacatactacgtagactccgtgaagggccgattcaccatctccagagacaattccaagaacacgctgtatcttcaaatgaacagcctgagagccgaggacacggccgtgtattactgtgcgagagtggggggagcacatagtggctacgacggatcctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaangacaccctcatgatctcccggacccctganncacatgcgtggtggnggacgtgagccacgaagacctganncaagttcantggtacntggnnngcntgnnngcatgatgncnnnannanncnnnnnagannngtnnnnnannanntancnggnnnnnnncngtgnnngnncnnnnntncncnnnnctnnnnnnnannngggnnnnannggnannnnnnnnnnnnnannggnntnnnnnnannnnnnnnnncnnnnnnnnannnnnnnnnnnnnnnnnnnnnaaancnnnnnggnnnnncccn

SEQ ID NO: 3606 - DNA, 367 bp, Artificial Sequence; identical to SEQ ID NO: 331
  source: /note="Description of Artificial Sequence: Synthetic polynucleotide"

SEQ ID NO: 3607 - DNA, 1200 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (13)..(13): a, c, t, g, unknown or other
  modified_base (16)..(17): a, c, t, g, unknown or other
  modified_base (848)..(848): a, c, t, g, unknown or other
  modified_base (850)..(852): a, c, t, g, unknown or other
  modified_base (854)..(854): a, c, t, g, unknown or other
  modified_base (857)..(857): a, c, t, g, unknown or other
  modified_base (859)..(860): a, c, t, g, unknown or other
  modified_base (863)..(863): a, c, t, g, unknown or other
  modified_base (868)..(869): a, c, t, g, unknown or other
  modified_base (871)..(876): a, c, t, g, unknown or other
  modified_base (880)..(883): a, c, t, g, unknown or other
  modified_base (885)..(885): a, c, t, g, unknown or other
  modified_base (891)..(891): a, c, t, g, unknown or other
  modified_base (896)..(896): a, c, t, g, unknown or other
  modified_base (899)..(899): a, c, t, g, unknown or other
  modified_base (903)..(903): a, c, t, g, unknown or other
  modified_base (912)..(912): a, c, t, g, unknown or other
  modified_base (922)..(922): a, c, t, g, unknown or other
  modified_base (928)..(928): a, c, t, g, unknown or other
  modified_base (931)..(933): a, c, t, g, unknown or other
  modified_base (938)..(938): a, c, t, g, unknown or other
  modified_base (941)..(942): a, c, t, g, unknown or other
  modified_base (946)..(948): a, c, t, g, unknown or other
  modified_base (956)..(956): a, c, t, g, unknown or other
  modified_base (960)..(960): a, c, t, g, unknown or other
  modified_base (964)..(964): a, c, t, g, unknown or other
  modified_base (967)..(969): a, c, t, g, unknown or other
  modified_base (971)..(972): a, c, t, g, unknown or other
  modified_base (975)..(976): a, c, t, g, unknown or other
  modified_base (978)..(978): a, c, t, g, unknown or other
  modified_base (991)..(991): a, c, t, g, unknown or other
  modified_base (993)..(994): a, c, t, g, unknown or other
  modified_base (997)..(997): a, c, t, g, unknown or other
  modified_base (999)..(1003): a, c, t, g, unknown or other
  modified_base (1009)..(1010): a, c, t, g, unknown or other
  modified_base (1012)..(1012): a, c, t, g, unknown or other
  modified_base (1016)..(1017): a, c, t, g, unknown or other
  modified_base (1019)..(1021): a, c, t, g, unknown or other
  modified_base (1026)..(1026): a, c, t, g, unknown or other
  modified_base (1028)..(1032): a, c, t, g, unknown or other
  modified_base (1034)..(1034): a, c, t, g, unknown or other
  modified_base (1036)..(1036): a, c, t, g, unknown or other
  modified_base (1038)..(1038): a, c, t, g, unknown or other
  modified_base (1041)..(1044): a, c, t, g, unknown or other
  modified_base (1046)..(1048): a, c, t, g, unknown or other
  modified_base (1050)..(1063): a, c, t, g, unknown or other
  modified_base (1066)..(1067): a, c, t, g, unknown or other
  modified_base (1070)..(1070): a, c, t, g, unknown or other
  modified_base (1076)..(1082): a, c, t, g, unknown or other
  modified_base (1084)..(1084): a, c, t, g, unknown or other
  modified_base (1087)..(1087): a, c, t, g, unknown or other
  modified_base (1089)..(1089): a, c, t, g, unknown or other
  modified_base (1091)..(1093): a, c, t, g, unknown or other
  modified_base (1095)..(1098): a, c, t, g, unknown or other
  modified_base (1103)..(1103): a, c, t, g, unknown or other
  modified_base (1105)..(1106): a, c, t, g, unknown or other
  modified_base (1108)..(1114): a, c, t, g, unknown or other
  modified_base (1117)..(1120): a, c, t, g, unknown or other
  modified_base (1123)..(1124): a, c, t, g, unknown or other
  modified_base (1129)..(1130): a, c, t, g, unknown or other
  modified_base (1132)..(1134): a, c, t, g, unknown or other
  modified_base (1138)..(1139): a, c, t, g, unknown or other
  modified_base (1143)..(1145): a, c, t, g, unknown or other
  modified_base (1147)..(1148): a, c, t, g, unknown or other
  modified_base (1150)..(1151): a, c, t, g, unknown or other
  modified_base (1153)..(1165): a, c, t, g, unknown or other
  modified_base (1171)..(1171): a, c, t, g, unknown or other
  modified_base (1173)..(1173): a, c, t, g, unknown or other
  modified_base (1175)..(1177): a, c, t, g, unknown or other
  modified_base (1179)..(1184): a, c, t, g, unknown or other
  modified_base (1186)..(1200): a, c, t, g, unknown or other
nnnnnncnnatgnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttgggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgncnnngnccnannttngttanntnnnnnnttannnngnttacanataangcnatantcatcacanattttcacanaataanagnnnttttnttnnctgnnnttctagtngtgngttntgnnnanntcnncntcagtgtatcatnanngtntnnnnnatcgannanttanntnnncgcancnnnnngncngnaannnncnnntnnnnnnnnnnnnnnagnnctnctgagnnnnnnncntcngngnnngnnnncagtngnngnnnnnnnccnnnnccnncagcnnannngcanncatnnntnnannannnnnnnnnnnnnagtccngncnnngnnnnnnannnnnnnnnnnnnnn

SEQ ID NO: 3608 - DNA, 331 bp, Artificial Sequence; identical to SEQ ID NO: 332
  source: /note="Description of Artificial Sequence: Synthetic polynucleotide"

SEQ ID NO: 3609 - DNA, 1249 bp, Artificial Sequence
  source: /note="Description of Artificial Sequence: Synthetic polynucleotide"
  modified_base (1)..(21): a, c, t, g, unknown or other
  modified_base (27)..(27): a, c, t, g, unknown or other
  modified_base (963)..(963): a, c, t, g, unknown or other
  modified_base (973)..(973): a, c, t, g, unknown or other
  modified_base (997)..(998): a, c, t, g, unknown or other
  modified_base (1013)..(1014): a, c, t, g, unknown or other
  modified_base (1032)..(1032): a, c, t, g, unknown or other
  modified_base (1035)..(1036): a, c, t, g, unknown or other
  modified_base (1038)..(1038): a, c, t, g, unknown or other
  modified_base (1050)..(1050): a, c, t, g, unknown or other
  modified_base (1054)..(1054): a, c, t, g, unknown or other
  modified_base (1061)..(1061): a, c, t, g, unknown or other
  modified_base (1063)..(1066): a, c, t, g, unknown or other
  modified_base (1069)..(1069): a, c, t, g, unknown or other
  modified_base (1073)..(1074): a, c, t, g, unknown or other
  modified_base (1076)..(1076): a, c, t, g, unknown or other
  modified_base (1100)..(1100): a, c, t, g, unknown or other
  modified_base (1102)..(1103): a, c, t, g, unknown or other
  modified_base (1106)..(1107): a, c, t, g, unknown or other
  modified_base (1109)..(1110): a, c, t, g, unknown or other
  modified_base (1116)..(1117): a, c, t, g, unknown or other
  modified_base (1122)..(1125): a, c, t, g, unknown or other
  modified_base (1127)..(1127): a, c, t, g, unknown or other
  modified_base (1133)..(1134): a, c, t, g, unknown or other
  modified_base (1137)..(1137): a, c, t, g, unknown or other
  modified_base (1139)..(1141): a, c, t, g, unknown or other
  modified_base (1144)..(1144): a, c, t, g, unknown or other
  modified_base (1146)..(1146): a, c, t, g, unknown or other
  modified_base (1148)..(1149): a, c, t, g, unknown or other
  modified_base (1152)..(1155): a, c, t, g, unknown or other
  modified_base (1159)..(1162): a, c, t, g, unknown or other
  modified_base (1165)..(1165): a, c, t, g, unknown or other
  modified_base (1169)..(1172): a, c, t, g, unknown or other
  modified_base (1177)..(1179): a, c, t, g, unknown or other
  modified_base (1181)..(1182): a, c, t, g, unknown or other
  modified_base (1184)..(1186): a, c, t, g, unknown or other
  modified_base (1191)..(1193): a, c, t, g, unknown or other
  modified_base (1195)..(1204): a, c, t, g, unknown or other
  modified_base (1206)..(1206): a, c, t, g, unknown or other
  modified_base (1208)..(1211): a, c, t, g, unknown or other
  modified_base (1214)..(1214): a, c, t, g, unknown or other
  modified_base (1216)..(1222): a, c, t, g, unknown or other
  modified_base (1226)..(1237): a, c, t, g, unknown or other
  modified_base (1243)..(1249): a, c, t, g, unknown or other
nnnnnnnnnnnnnnnnnnnnntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtcgctatggcatgcactgggtccgccaggctccaggcaaggggctggagtgggtggcagttatgtcatatgatggaagtagtaaatactatgcagactccgtgaagggccgattcaccatctccagagacaattccaagaacacgctgtgtctgcaaatgaacagcctgagagctgaggacacggctgtgtattactgtgcgaaacaggcgggcccatattgtagtggtggtagctgctactccgcgccctttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaangacaccctcntgatctcccggacccctgaggtcnnatgcgtggtggtggnngtgagccacgaagacccnganncnagttcaactggnacgnggacggngnnnnggngcannangccaagacaaagccgcgggaggancnntannannagcacnnaccgnnnngncagcgnnccntnnncgncngnnccnnnnactnnnnaanggcnnnntacannncnngnnntccannnannnnnnnnnncntnnnnaancnnnnnnncaannnnnnnnnnnncccccnnnnnnn

SEQ ID NO: 3610 - DNA, 382 bp, Artificial Sequence; identical to SEQ ID NO: 333
  source: /note="Description of Artificial Sequence: Synthetic polynucleotide"

SEQ ID NO: 3611 - DNA, 1210 bp, Artificial Sequence
  source: /note="Description of Artificial Sequence: Synthetic polynucleotide"
  modified_base (1)..(10): a, c, t, g, unknown or other
  modified_base (13)..(13): a, c, t, g, unknown or other
  modified_base (17)..(17): a, c, t, g, unknown or other
  modified_base (938)..(941): a, c, t, g, unknown or other
  modified_base (948)..(948): a, c, t, g, unknown or other
  modified_base (951)..(951): a, c, t, g, unknown or other
  modified_base (954)..(957): a, c, t, g, unknown or other
  modified_base (959)..(969): a, c, t, g, unknown or other
  modified_base (972)..(972): a, c, t, g, unknown or other
  modified_base (978)..(978): a, c, t, g, unknown or other
  modified_base (980)..(982): a, c, t, g, unknown or other
  modified_base (989)..(991): a, c, t, g, unknown or other
  modified_base (995)..(996): a, c, t, g, unknown or other
  modified_base (1006)..(1007): a, c, t, g, unknown or other
  modified_base (1013)..(1015): a, c, t, g, unknown or other
  modified_base (1018)..(1020): a, c, t, g, unknown or other
  modified_base (1025)..(1025): a, c, t, g, unknown or other
  modified_base (1027)..(1029): a, c, t, g, unknown or other
  modified_base (1038)..(1046): a, c, t, g, unknown or other
  modified_base (1050)..(1051): a, c, t, g, unknown or other
  modified_base (1055)..(1055): a, c, t, g, unknown or other
  modified_base (1059)..(1059): a, c, t, g, unknown or other
  modified_base (1063)..(1064): a, c, t, g, unknown or other
  modified_base (1066)..(1066): a, c, t, g, unknown or other
  modified_base (1068)..(1071): a, c, t, g, unknown or other
  modified_base (1073)..(1076): a, c, t, g, unknown or other
  modified_base (1083)..(1083): a, c, t, g, unknown or other
  modified_base (1085)..(1086): a, c, t, g, unknown or other
  modified_base (1088)..(1089): a, c, t, g, unknown or other
  modified_base (1097)..(1099): a, c, t, g, unknown or other
  modified_base (1101)..(1101): a, c, t, g, unknown or other
  modified_base (1105)..(1108): a, c, t, g, unknown or other
  modified_base (1110)..(1112): a, c, t, g, unknown or other
  modified_base (1114)..(1116): a, c, t, g, unknown or other
  modified_base (1120)..(1121): a, c, t, g, unknown or other
  modified_base (1124)..(1126): a, c, t, g, unknown or other
  modified_base (1128)..(1135): a, c, t, g, unknown or other
  modified_base (1137)..(1139): a, c, t, g, unknown or other
  modified_base (1141)..(1141): a, c, t, g, unknown or other
  modified_base (1145)..(1145): a, c, t, g, unknown or other
  modified_base (1147)..(1147): a, c, t, g, unknown or other
  modified_base (1149)..(1155): a, c, t, g, unknown or other
  modified_base (1157)..(1169): a, c, t, g, unknown or other
  modified_base (1172)..(1177): a, c, t, g, unknown or other
  modified_base (1179)..(1198): a, c, t, g, unknown or other
  modified_base (1201)..(1210): a, c, t, g, unknown or other
nnnnnnnnnntgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccaggcgagtcagggcattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctnnnntgtgggnttntgnnnnannnnnnnnnnngtntcatancnnntcggggnnngggnnattaattcgnngcagcnnntgnnngaaanannntgaaagagnnnnnnnnnactnngagngaanaacnncngnnnngnnnngtcagtngnngnngaaagtcnnngntccnnnngnnnannnatgnnaannntnnnnnnnntnnncngcancngnnnnnnnannnnnnnnnnnnnggnnnnnnannnnnnnnnnnnnnnnnnnnccnnnnnnnnnn

SEQ ID NO: 3612 - DNA, 322 bp, Artificial Sequence; identical to SEQ ID NO: 334
  source: /note="Description of Artificial Sequence: Synthetic polynucleotide"

SEQ ID NO: 3613 - DNA, 1247 bp, Artificial Sequence
  source: /note="Description of Artificial Sequence: Synthetic polynucleotide"
  modified_base (1)..(12): a, c, t, g, unknown or other
  modified_base (15)..(19): a, c, t, g, unknown or other
  modified_base (24)..(25): a, c, t, g, unknown or other
  modified_base (77)..(78): a, c, t, g, unknown or other
  modified_base (80)..(80): a, c, t, g, unknown or other
  modified_base (899)..(899): a, c, t, g, unknown or other
  modified_base (978)..(978): a, c, t, g, unknown or other
  modified_base (981)..(981): a, c, t, g, unknown or other
  modified_base (988)..(988): a, c, t, g, unknown or other
  modified_base (1002)..(1004): a, c, t, g, unknown or other
  modified_base (1019)..(1019): a, c, t, g, unknown or other
  modified_base (1022)..(1023): a, c, t, g, unknown or other
  modified_base (1028)..(1028): a, c, t, g, unknown or other
  modified_base (1031)..(1033): a, c, t, g, unknown or other
  modified_base (1038)..(1038): a, c, t, g, unknown or other
  modified_base (1043)..(1045): a, c, t, g, unknown or other
  modified_base (1049)..(1049): a, c, t, g, unknown or other
  modified_base (1056)..(1057): a, c, t, g, unknown or other
  modified_base (1063)..(1063): a, c, t, g, unknown or other
  modified_base (1068)..(1068): a, c, t, g, unknown or other
  modified_base (1070)..(1070): a, c, t, g, unknown or other
  modified_base (1074)..(1074): a, c, t, g, unknown or other
  modified_base (1094)..(1097): a, c, t, g, unknown or other
  modified_base (1100)..(1100): a, c, t, g, unknown or other
  modified_base (1103)..(1103): a, c, t, g, unknown or other
  modified_base (1105)..(1106): a, c, t, g, unknown or other
  modified_base (1109)..(1110): a, c, t, g, unknown or other
  modified_base (1112)..(1113): a, c, t, g, unknown or other
  modified_base (1117)..(1117): a, c, t, g, unknown or other
  modified_base (1119)..(1120): a, c, t, g, unknown or other
  modified_base (1126)..(1128): a, c, t, g, unknown or other
  modified_base (1131)..(1134): a, c, t, g, unknown or other
  modified_base (1136)..(1139): a, c, t, g, unknown or other
  modified_base (1141)..(1146): a, c, t, g, unknown or other
  modified_base (1150)..(1151): a, c, t, g, unknown or other
  modified_base (1156)..(1159): a, c, t, g, unknown or other
  modified_base (1162)..(1162): a, c, t, g, unknown or other
  modified_base (1167)..(1167): a, c, t, g, unknown or other
  modified_base (1171)..(1175): a, c, t, g, unknown or other
  modified_base (1179)..(1180): a, c, t, g, unknown or other
  modified_base (1182)..(1186): a, c, t, g, unknown or other
  modified_base (1188)..(1195): a, c, t, g, unknown or other
  modified_base (1197)..(1211): a, c, t, g, unknown or other
  modified_base (1213)..(1216): a, c, t, g, unknown or other
  modified_base (1219)..(1221): a, c, t, g, unknown or other
  modified_base (1223)..(1224): a, c, t, g, unknown or other
  modified_base (1227)..(1234): a, c, t, g, unknown or other
  modified_base (1236)..(1237): a, c, t, g, unknown or other
  modified_base (1240)..(1247): a, c, t, g, unknown or other
nnnnnnnnnnnntgnnnnntacanntacgatttaggtgacactatagaataacatccactttgcctttctctccacnngngtccactcccaggtccaactgcacctcggttctatcgattgaattccaccatgggatggtcatgtatcatcctttttctagtagcaactgcaaccggtgtacattctgaggtgcagctggtggagtctggaggaggcttgatccagcctggggggtccctgagactctcctgtgcagcctctgggttcatcgtcagtagcaactacatgagctgggtccgccaggctccagggaagggcctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagagattttggagagttctactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggancgtcagtcttcctcttccccccaaaacccaaggacaccctcatgatctcccggacccctgaggtcacatgcgtggtggnggnacgtganccacgaagaccctnnngtcagttcaactggnacnnggaanggnnntggangtgcnnnatgncaagaannaagccncgggnanggancagtacacagcacgtaccgnnnnggncancnnccnncnncgtncnncaccannnctnnnnannnnannnnnnacanngcagnnnncancaaancccnnnnncccnntnnnnnannnnnnnnannnnnnnnnnnnnnnannnnggnnnannccnnnnnnnntnnccnnnnnnnn

SEQ ID NO: 3614 - DNA, 352 bp, Artificial Sequence; identical to SEQ ID NO: 335
  source: /note="Description of Artificial Sequence: Synthetic polynucleotide"

SEQ ID NO: 3615 - DNA, 1145 bp, Artificial Sequence
  source: /note="Description of Artificial Sequence: Synthetic polynucleotide"
  modified_base (1)..(9): a, c, t, g, unknown or other
  modified_base (17)..(17): a, c, t, g, unknown or other
  modified_base (839)..(839): a, c, t, g, unknown or other
  modified_base (849)..(851): a, c, t, g, unknown or other
  modified_base (853)..(854): a, c, t, g, unknown or other
  modified_base (856)..(858): a, c, t, g, unknown or other
  modified_base (863)..(863): a, c, t, g, unknown or other
  modified_base (866)..(867): a, c, t, g, unknown or other
  modified_base (877)..(878): a, c, t, g, unknown or other
  modified_base (881)..(881): a, c, t, g, unknown or other
  modified_base (898)..(898): a, c, t, g, unknown or other
  modified_base (905)..(905): a, c, t, g, unknown or other
  modified_base (929)..(929): a, c, t, g, unknown or other
  modified_base (939)..(939): a, c, t, g, unknown or other
  modified_base (942)..(944): a, c, t, g, unknown or other
  modified_base (947)..(947): a, c, t, g, unknown or other
  modified_base (954)..(954): a, c, t, g, unknown or other
  modified_base (960)..(960): a, c, t, g, unknown or other
  modified_base (962)..(962): a, c, t, g, unknown or other
  modified_base (964)..(964): a, c, t, g, unknown or other
  modified_base (971)..(974): a, c, t, g, unknown or other
  modified_base (977)..(982): a, c, t, g, unknown or other
  modified_base (984)..(984): a, c, t, g, unknown or other
  modified_base (986)..(986): a, c, t, g, unknown or other
  modified_base (988)..(990): a, c, t, g, unknown or other
  modified_base (992)..(995): a, c, t, g, unknown or other
  modified_base (998)..(1000): a, c, t, g, unknown or other
  modified_base (1002)..(1002): a, c, t, g, unknown or other
  modified_base (1005)..(1007): a, c, t, g, unknown or other
  modified_base (1009)..(1009): a, c, t, g, unknown or other
  modified_base (1014)..(1015): a, c, t, g, unknown or other
  modified_base (1021)..(1021): a, c, t, g, unknown or other
  modified_base (1026)..(1026): a, c, t, g, unknown or other
  modified_base (1028)..(1030): a, c, t, g, unknown or other
  modified_base (1038)..(1038): a, c, t, g, unknown or other
  modified_base (1041)..(1041): a, c, t, g, unknown or other
  modified_base (1043)..(1046): a, c, t, g, unknown or other
  modified_base (1049)..(1049): a, c, t, g, unknown or other
  modified_base (1051)..(1051): a, c, t, g, unknown or other
  modified_base (1053)..(1061): a, c, t, g, unknown or other
  modified_base (1063)..(1070): a, c, t, g, unknown or other
  modified_base (1072)..(1073): a, c, t, g, unknown or other
  modified_base (1075)..(1075): a, c, t, g, unknown or other
  modified_base (1077)..(1078): a, c, t, g, unknown or other
  modified_base (1080)..(1084): a, c, t, g, unknown or other
  modified_base (1086)..(1090): a, c, t, g, unknown or other
  modified_base (1092)..(1108): a, c, t, g, unknown or other
  modified_base (1110)..(1110): a, c, t, g, unknown or other
  modified_base (1112)..(1112): a, c, t, g, unknown or other
  modified_base (1114)..(1124): a, c, t, g, unknown or other
  modified_base (1126)..(1126): a, c, t, g, unknown or other
  modified_base (1128)..(1134): a, c, t, g, unknown or other
  modified_base (1137)..(1145): a, c, t, g, unknown or other
nnnnnnnnnatgtatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactgctatcccagccaggttcagtggcagtgggtctgggacagagttcactctcaccatcagcagcctgcagtctgaagattttgcagtttattactgtcagcagtataataactggcctcggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggnccgccatggnnncnncnnnttgtntanngcatcttatnntgnttacaaataagcaatancatcacnaatttcacaaataaagcatttttntcactgcatntannntgnttgtccnaactcntnangtatctnnnntgnnnnnncngnannntnnnncannncntgnnngnaatannctgaanagaantnnngtactctnagngnnnnaanancnnnnnnnnngnnnnnnnngnngngnnannnnncnnnnncnnnnnnnnnnnnnnnnnangntnnnnnnnnnnncngnnnnnnnccnnnnnnnnn

SEQ ID NO: 3616 - DNA, 322 bp, Artificial Sequence
  source: /note="Description of Artificial Sequence: Synthetic polynucleotide"
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactgctatcccagccaggttcagtggcagtgggtctgggacagagttcactctcaccatcagcagcctgcagtctgaagattttgcagtttattactgtcagcagtataataactggcctcggacgttcggccaagggaccaaggtggaaatcaaac

SEQ ID NO: 3617 - DNA, 1241 bp, Artificial Sequence
  source: /note="Description of Artificial Sequence: Synthetic polynucleotide"
  modified_base (1)..(14): a, c, t, g, unknown or other
  modified_base (16)..(16): a, c, t, g, unknown or other
  modified_base (18)..(18): a, c, t, g, unknown or other
  modified_base (20)..(21): a, c, t, g, unknown or other
  modified_base (23)..(27): a, c, t, g, unknown or other
  modified_base (37)..(37): a, c, t, g, unknown or other
  modified_base (49)..(49): a, c, t, g, unknown or other
  modified_base (79)..(79): a, c, t, g, unknown or other
  modified_base (964)..(965): a, c, t, g, unknown or other
  modified_base (975)..(975): a, c, t, g, unknown or other
  modified_base (977)..(977): a, c, t, g, unknown or other
  modified_base (1003)..(1003): a, c, t, g, unknown or other
  modified_base (1020)..(1020): a, c, t, g, unknown or other
  modified_base (1029)..(1029): a, c, t, g, unknown or other
  modified_base (1044)..(1045): a, c, t, g, unknown or other
  modified_base (1048)..(1048): a, c, t, g, unknown or other
  modified_base (1053)..(1053): a, c, t, g, unknown or other
  modified_base (1058)..(1063): a, c, t, g, unknown or other
  modified_base (1068)..(1068): a, c, t, g, unknown or other
  modified_base (1070)..(1070): a, c, t, g, unknown or other
  modified_base (1074)..(1074): a, c, t, g, unknown or other
  modified_base (1076)..(1078): a, c, t, g, unknown or other
  modified_base (1085)..(1087): a, c, t, g, unknown or other
  modified_base (1093)..(1093): a, c, t, g, unknown or other
  modified_base (1099)..(1099): a, c, t, g, unknown or other
  modified_base (1101)..(1102): a, c, t, g, unknown or other
  modified_base (1109)..(1110): a, c, t, g, unknown or other
  modified_base (1114)..(1119): a, c, t, g, unknown or other
  modified_base (1121)..(1123): a, c, t, g, unknown or other
  modified_base (1126)..(1126): a, c, t, g, unknown or other
  modified_base (1129)..(1130): a, c, t, g, unknown or other
  modified_base (1133)..(1134): a, c, t, g, unknown or other
  modified_base (1136)..(1137): a, c, t, g, unknown or other
  modified_base (1142)..(1145): a, c, t, g, unknown or other
  modified_base (1147)..(1150): a, c, t, g, unknown or other
  modified_base (1152)..(1155): a, c, t, g, unknown or other
  modified_base (1158)..(1158): a, c, t, g, unknown or other
  modified_base (1160)..(1161): a, c, t, g, unknown or other
  modified_base (1163)..(1163): a, c, t, g, unknown or other
  modified_base (1165)..(1168): a, c, t, g, unknown or other
  modified_base (1171)..(1173): a, c, t, g, unknown or other
  modified_base (1175)..(1175): a, c, t, g, unknown or other
  modified_base (1180)..(1181): a, c, t, g, unknown or other
  modified_base (1183)..(1183): a, c, t, g, unknown or other
  modified_base (1185)..(1185): a, c, t, g, unknown or other
  modified_base (1188)..(1189): a, c, t, g, unknown or other
  modified_base (1191)..(1197): a, c, t, g, unknown or other
  modified_base (1199)..(1203): a, c, t, g, unknown or other
  modified_base (1205)..(1206): a, c, t, g, unknown or other
  modified_base (1208)..(1211): a, c, t, g, unknown or other
  modified_base (1213)..(1217): a, c, t, g, unknown or other
  modified_base (1221)..(1221): a, c, t, g, unknown or other
  modified_base (1223)..(1233): a, c, t, g, unknown or other
  modified_base (1235)..(1241): a, c, t, g, unknown or other
nnnnnnnnnnnnnngngntnntnnnnntacgatttangtgacactatanaataacatccactttgcctttctctccacnggtgtccactcccaggtccaactgcacctcggttctatcgattgaattccaccatgggatggtcatgtatcatcctttttctagtagcaactgcaaccggtgtacattctcaggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatatgatggaaataataaatactatgcagactccgtgaagggccgattcaccatctccagagacaattccaagaacacgctgtatctgcaaatgaacagcctgagagctgaggacacggctgtgtattactgtgcgaaagatcctttccccttagcagtggctgggacgggctactttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcnntgatctcccngnacccctgaggtcacatgcgtggtggnggacgtgagccacgaanaccctgagncaagtttcaactggnnacntgganggcgnnnnnngcatnangccnannnaaagccnnngaggancagtananngcacgtnnccgnnnnnnannntcntcnncgnncnncaccnnnntnnnnannnnagnannanannnnagnnncnacaanncntnccnncnnnnnnnannnnntnnannnnannnnncccncnnnnnnnnnnngnnnnnnn

SEQ ID NO: 3618 - DNA, 373 bp, Artificial Sequence; identical to SEQ ID NO: 337
  source: /note="Description of Artificial Sequence: Synthetic polynucleotide"

SEQ ID NO: 3619 - DNA, 1258 bp, Artificial Sequence
  source: /note="Description of Artificial Sequence: Synthetic polynucleotide"
  modified_base (1)..(6): a, c, t, g, unknown or other
  modified_base (8)..(9): a, c, t, g, unknown or other
  modified_base (13)..(13): a, c, t, g, unknown or other
  modified_base (17)..(17): a, c, t, g, unknown or other
  modified_base (951)..(951): a, c, t, g, unknown or other
  modified_base (993)..(993): a, c, t, g, unknown or other
  modified_base (995)..(995): a, c, t, g, unknown or other
  modified_base (1002)..(1002): a, c, t, g, unknown or other
  modified_base (1007)..(1007): a, c, t, g, unknown or other
  modified_base (1014)..(1014): a, c, t, g, unknown or other
  modified_base (1020)..(1022): a, c, t, g, unknown or other
  modified_base (1032)..(1037): a, c, t, g, unknown or other
  modified_base (1039)..(1042): a, c, t, g, unknown or other
  modified_base (1044)..(1048): a, c, t, g, unknown or other
  modified_base (1050)..(1056): a, c, t, g, unknown or other
  modified_base (1059)..(1062): a, c, t, g, unknown or other
  modified_base (1064)..(1066): a, c, t, g, unknown or other
  modified_base (1068)..(1072): a, c, t, g, unknown or other
  modified_base (1074)..(1074): a, c, t, g, unknown or other
  modified_base (1076)..(1083): a, c, t, g, unknown or other
  modified_base (1085)..(1086): a, c, t, g, unknown or other
  modified_base (1088)..(1095): a, c, t, g, unknown or other
  modified_base (1099)..(1100): a, c, t, g, unknown or other
  modified_base (1108)..(1108): a, c, t, g, unknown or other
  modified_base (1110)..(1111): a, c, t, g, unknown or other
  modified_base (1113)..(1119): a, c, t, g, unknown or other
  modified_base (1121)..(1123): a, c, t, g, unknown or other
  modified_base (1127)..(1127): a, c, t, g, unknown or other
  modified_base (1129)..(1129): a, c, t, g, unknown or other
  modified_base (1132)..(1134): a, c, t, g, unknown or other
  modified_base (1138)..(1140): a, c, t, g, unknown or other
  modified_base (1143)..(1143): a, c, t, g, unknown or other
  modified_base (1145)..(1145): a, c, t, g, unknown or other
  modified_base (1147)..(1149): a, c, t, g, unknown or other
  modified_base (1151)..(1156): a, c, t, g, unknown or other
  modified_base (1158)..(1158): a, c, t, g, unknown or other
  modified_base (1160)..(1160): a, c, t, g, unknown or other
  modified_base (1164)..(1164): a, c, t, g, unknown or other
  modified_base (1167)..(1171): a, c, t, g, unknown or other
  modified_base (1173)..(1175): a, c, t, g, unknown or other
  modified_base (1177)..(1177): a, c, t, g, unknown or other
  modified_base (1179)..(1180): a, c, t, g, unknown or other
  modified_base (1182)..(1187): a, c, t, g, unknown or other
  modified_base (1189)..(1192): a, c, t, g, unknown or other
  modified_base (1195)..(1200): a, c, t, g, unknown or other
  modified_base (1202)..(1206): a, c, t, g, unknown or other
  modified_base (1208)..(1220): a, c, t, g, unknown or other
  modified_base (1222)..(1251): a, c, t, g, unknown or other
  modified_base (1253)..(1254): a, c, t, g, unknown or other
  modified_base (1257)..(1257): a, c, t, g, unknown or other
nnnnnncnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgactcagccaccctcggtgtcagtggccccaggacagacggccaggatttcctgtgggggaaacaacattggaagtaaaaatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatccttgggtgttcggcggagggaccaagctgaccgtcctaggtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcattttttttcactgcattctagttgtggtttgnccaaactcatcaatgtatcttatcatgtctggatcgggaatnanttctgcncagcnccatggncctggnnntagcactgannnnnnannnngnnnnngnnnnnnnttnnnntnnnannnnnancnnnnnnnncnntnnnnnnnnatgnngtgtcagntnngnnnnnnnannntccncnggnnncccnnnagnanannntnnnnnncntncatntcnnnnncnnnancnngnnnnnnannnnccnnnnnncnnnnngnnnnnnnnnnnnnannnnnnnnnnnnnnnnnnnnnnnnnnnnnncnnaanc

SEQ ID NO: 3620 - DNA, 325 bp, Artificial Sequence
  source: /note="Description of Artificial Sequence: Synthetic polynucleotide"
tcctatgtgctgactcagccaccctcggtgtcagtggccccaggacagacggccaggatttcctgtgggggaaacaacattggaagtaaaaatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatccttgggtgttcggcggagggaccaagctgaccgtcctag

SEQ ID NO: 3621 - DNA, 1144 bp, Artificial Sequence
  source: /note="Description of Artificial Sequence: Synthetic polynucleotide"
  modified_base (1)..(8): a, c, t, g, unknown or other
  modified_base (17)..(17): a, c, t, g, unknown or other
  modified_base (23)..(23): a, c, t, g, unknown or other
  modified_base (940)..(942): a, c, t, g, unknown or other
  modified_base (997)..(997): a, c, t, g, unknown or other
  modified_base (1007)..(1008): a, c, t, g, unknown or other
  modified_base (1013)..(1019): a, c, t, g, unknown or other
  modified_base (1022)..(1025): a, c, t, g, unknown or other
  modified_base (1027)..(1027): a, c, t, g, unknown or other
  modified_base (1029)..(1030): a, c, t, g, unknown or other
  modified_base (1033)..(1033): a, c, t, g, unknown or other
  modified_base (1035)..(1035): a, c, t, g, unknown or other
  modified_base (1038)..(1038): a, c, t, g, unknown or other
  modified_base (1040)..(1041): a, c, t, g, unknown or other
  modified_base (1043)..(1044): a, c, t, g, unknown or other
  modified_base (1046)..(1046): a, c, t, g, unknown or other
  modified_base (1050)..(1050): a, c, t, g, unknown or other
  modified_base (1052)..(1052): a, c, t, g, unknown or other
  modified_base (1054)..(1054): a, c, t, g, unknown or other
  modified_base (1067)..(1072): a, c, t, g, unknown or other
  modified_base (1076)..(1077): a, c, t, g, unknown or other
  modified_base (1080)..(1082): a, c, t, g, unknown or other
  modified_base (1087)..(1087): a, c, t, g, unknown or other
  modified_base (1090)..(1090): a, c, t, g, unknown or other
  modified_base (1099)..(1100): a, c, t, g, unknown or other
  modified_base (1105)..(1106): a, c, t, g, unknown or other
  modified_base (1110)..(1114): a, c, t, g, unknown or other
  modified_base (1117)..(1130): a, c, t, g, unknown or other
  modified_base (1132)..(1132): a, c, t, g, unknown or other
  modified_base (1135)..(1135): a, c, t, g, unknown or other
  modified_base (1137)..(1144): a, c, t, g, unknown or other
nnnnnnnntatgtatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctgttggagtctgggggaggcttggtacaacctggggggtccctgagactctcctgtgcagcctctggattcacctttagcagctatgccatgagctgggtccgccaggctccagggaaggggctggagtgggtctcagctaccagtgatagtggtggtaccacatactacgcagactccgtgaaggggcggttcaccatctccagagacaattccaagaacacgctgtatctgcaaatgaatagtctgagagccgaggacacggccatatattactgtgcgaggagaggaaatagtgggagctaccctgaccctgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccannncaccctcatgatctcccggacccctgaggtcacatgcgtggtggtggaggtgagncacgagaccnngaagnnnnnnnagnnnngntnnagntnggnanngnnanggcntngnaggtgcataatgnnnnnnaaannccnnngggangancagtacaanngcacnnaccnnnnnggnnnnnnnnnnnnnncngtncnnnnnnnn

SEQ ID NO: 3622 - DNA, 364 bp, Artificial Sequence
  source: /note="Description of Artificial Sequence: Synthetic polynucleotide"
  modified_base (355)..(355): a, c, t, g, unknown or other
gaggtgcagctgttggagtctgggggaggcttggtacaacctggggggtccctgagactctcctgtgcagcctctggattcacctttagcagctatgccatgagctgggtccgccaggctccagggaaggggctggagtgggtctcagctaccagtgatagtggtggtaccacatactacgcagactccgtgaaggggcggttcaccatctccagagacaattccaagaacacgctgtatctgcaaatgaatagtctgagagccgaggacacggccatatattactgtgcgaggagaggaaatagtgggagctaccctgaccctgactactggggccagggaaccctggtcaccntctcctcag

SEQ ID NO: 3623 - DNA, 1121 bp, Artificial Sequence
  source: /note="Description of Artificial Sequence: Synthetic polynucleotide"
  modified_base (1)..(7): a, c, t, g, unknown or other
  modified_base (9)..(9): a, c, t, g, unknown or other
  modified_base (14)..(14): a, c, t, g, unknown or other
  modified_base (18)..(18): a, c, t, g, unknown or other
  modified_base (832)..(832): a, c, t, g, unknown or other
  modified_base (834)..(836): a, c, t, g, unknown or other
  modified_base (860)..(860): a, c, t, g, unknown or other
  modified_base (879)..(879): a, c, t, g, unknown or other
  modified_base (883)..(883): a, c, t, g, unknown or other
  modified_base (886)..(886): a, c, t, g, unknown or other
  modified_base (891)..(891): a, c, t, g, unknown or other
  modified_base (893)..(893): a, c, t, g, unknown or other
  modified_base (898)..(901): a, c, t, g, unknown or other
  modified_base (903)..(904): a, c, t, g, unknown or other
  modified_base (989)..(989): a, c, t, g, unknown or other
  modified_base (991)..(991): a, c, t, g, unknown or other
  modified_base (994)..(994): a, c, t, g, unknown or other
  modified_base (996)..(996): a, c, t, g, unknown or other
  modified_base (1003)..(1003): a, c, t, g, unknown or other
  modified_base (1008)..(1008): a, c, t, g, unknown or other
  modified_base (1012)..(1013): a, c, t, g, unknown or other
  modified_base (1016)..(1016): a, c, t, g, unknown or other
  modified_base (1022)..(1022): a, c, t, g, unknown or other
  modified_base (1028)..(1029): a, c, t, g, unknown or other
  modified_base (1033)..(1035): a, c, t, g, unknown or other
  modified_base (1044)..(1044): a, c, t, g, unknown or other
  modified_base (1051)..(1051): a, c, t, g, unknown or other
  modified_base (1057)..(1061): a, c, t, g, unknown or other
  modified_base (1065)..(1066): a, c, t, g, unknown or other
  modified_base (1070)..(1070): a, c, t, g, unknown or other
  modified_base (1076)..(1078): a, c, t, g, unknown or other
  modified_base (1080)..(1082): a, c, t, g, unknown or other
  modified_base (1085)..(1085): a, c, t, g, unknown or other
  modified_base (1088)..(1090): a, c, t, g, unknown or other
  modified_base (1094)..(1095): a, c, t, g, unknown or other
  modified_base (1097)..(1101): a, c, t, g, unknown or other
  modified_base (1106)..(1106): a, c, t, g, unknown or other
  modified_base (1108)..(1113): a, c, t, g, unknown or other
  modified_base (1116)..(1120): a, c, t, g, unknown or other
nnnnnnncntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcggacatcgtgatgacccagtctccagactccctggctgtgtctctgggcgagagggccaccatcaactgcaagtccagccagaatgttttatacagctccaacaataagaactacttagcttggtaccagcagaaaccaagacagcctcctaaactgctcatttactgggcatctacccgggaatccggggtccctgaccgattcagtggcagcgggtctgggacagatttcactctcaccatcagcagcctgcaggccgaagatgtggcagtttattactgtcagcaatattatactcttcgttggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcnannngggggagagtgttagaagcttggnccgccatggcccaacttgntttnttngcagntntatannnntnncaaataaagcaatagcatcacaaatttcacaaataaagcatttttttcactgcattctagttgtggtttgtccaaactcatcaangnatntnatcatgnctggntcgnnatnattcgngcagcnncatnnnctgaatacntctgaanagactnnnnnactnngagngaagannncnnnganggnnngtcnntnnnnnggggnannnnnnccnnnnnc

SEQ ID NO: 3624 - DNA, 340 bp, Artificial Sequence
  source: /note="Description of Artificial Sequence: Synthetic polynucleotide"
  modified_base (42)..(43): a, c, t, g, unknown or other
gacatcgtgatgacccagtctccagactccctggctgtgtcnntgggcgagagggccaccatcaactgcaagtccagccagaatgttttatacagctccaacaataagaactacttagcttggtaccagcagaaaccaagacagcctcctaaactgctcatttactgggcatctacccgggaatccggggtccctgaccgattcagtggcagcgggtctgggacagatttcactctcaccatcagcagcctgcaggccgaagatgtggcagtttattactgtcagcaatattatactcttcgttggacgttcggccaagggaccaaggtggaaatcaaac

SEQ ID NO: 3625 - DNA, 1169 bp, Artificial Sequence
  source: /note="Description of Artificial Sequence: Synthetic polynucleotide"
  modified_base (1)..(11): a, c, t, g, unknown or other
  modified_base (14)..(15): a, c, t, g, unknown or other
  modified_base (18)..(18): a, c, t, g, unknown or other
  modified_base (24)..(24): a, c, t, g, unknown or other
  modified_base (825)..(825): a, c, t, g, unknown or other
  modified_base (908)..(908): a, c, t, g, unknown or other
  modified_base (919)..(920): a, c, t, g, unknown or other
  modified_base (925)..(929): a, c, t, g, unknown or other
  modified_base (931)..(932): a, c, t, g, unknown or other
  modified_base (935)..(935): a, c, t, g, unknown or other
  modified_base (937)..(937): a, c, t, g, unknown or other
  modified_base (940)..(940): a, c, t, g, unknown or other
  modified_base (942)..(942): a, c, t, g, unknown or other
  modified_base (944)..(944): a, c, t, g, unknown or other
  modified_base (946)..(946): a, c, t, g, unknown or other
  modified_base (948)..(949): a, c, t, g, unknown or other
  modified_base (951)..(962): a, c, t, g, unknown or other
  modified_base (964)..(964): a, c, t, g, unknown or other
  modified_base (969)..(975): a, c, t, g, unknown or other
  modified_base (977)..(978): a, c, t, g, unknown or other
  modified_base (980)..(982): a, c, t, g, unknown or other
  modified_base (984)..(984): a, c, t, g, unknown or other
  modified_base (993)..(994): a, c, t, g, unknown or other
  modified_base (999)..(1003): a, c, t, g, unknown or other
  modified_base (1006)..(1006): a, c, t, g, unknown or other
  modified_base (1008)..(1011): a, c, t, g, unknown or other
  modified_base (1014)..(1014): a, c, t, g, unknown or other
  modified_base (1016)..(1016): a, c, t, g, unknown or other
  modified_base (1019)..(1020): a, c, t, g, unknown or other
  modified_base (1023)..(1023): a, c, t, g, unknown or other
  modified_base (1039)..(1039): a, c, t, g, unknown or other
  modified_base (1042)..(1042): a, c, t, g, unknown or other
  modified_base (1045)..(1045): a, c, t, g, unknown or other
  modified_base (1047)..(1048): a, c, t, g, unknown or other
  modified_base (1055)..(1058): a, c, t, g, unknown or other
  modified_base (1062)..(1063): a, c, t, g, unknown or other
  modified_base (1065)..(1065): a, c, t, g, unknown or other
  modified_base (1067)..(1067): a, c, t, g, unknown or other
  modified_base (1071)..(1071): a, c, t, g, unknown or other
  modified_base (1073)..(1074): a, c, t, g, unknown or other
  modified_base (1079)..(1081): a, c, t, g, unknown or other
  modified_base (1085)..(1085): a, c, t, g, unknown or other
  modified_base (1087)..(1088): a, c, t, g, unknown or other
  modified_base (1091)..(1091): a, c, t, g, unknown or other
  modified_base (1094)..(1094): a, c, t, g, unknown or other
  modified_base (1096)..(1096): a, c, t, g, unknown or other
  modified_base (1100)..(1100): a, c, t, g, unknown or other
  modified_base (1108)..(1108): a, c, t, g, unknown or other
  modified_base (1110)..(1112): a, c, t, g, unknown or other
  modified_base (1114)..(1114): a, c, t, g, unknown or other
  modified_base (1124)..(1128): a, c, t, g, unknown or other
  modified_base (1130)..(1130): a, c, t, g, unknown or other
  modified_base (1133)..(1133): a, c, t, g, unknown or other
  modified_base (1136)..(1137): a, c, t, g, unknown or other
  modified_base (1140)..(1140): a, c, t, g, unknown or other
  modified_base (1143)..(1143): a, c, t, g, unknown or other
  modified_base (1148)..(1148): a, c, t, g, unknown or other
  modified_base (1151)..(1151): a, c, t, g, unknown or other
  modified_base (1153)..(1153): a, c, t, g, unknown or other
  modified_base (1156)..(1156): a, c, t, g, unknown or other
  modified_base (1158)..(1158): a, c, t, g, unknown or other
  modified_base (1160)..(1162): a, c, t, g, unknown or other
  modified_base (1164)..(1169): a, c, t, g, unknown or other
nnnnnnnnnnntgnntcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctggggcctcagtgaaggtttcctgcaaggcatctggatacaccttcatcagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagggcaaatgagggagcagctgtttcatttgactactggggccagggaaccctggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtggacaagagagttgagcccaaatcttgtgacaaaactcacacatgcccaccgtgcccagcacctgaactcctgggggggancgtcagtcttnntcttnnnnncnnaananaangnanangnncnnnnnnnnnnnntncccgnnnnnnngnngnnncntggggtggnnggtgnnnnngancnnnnaananccnngangtcaagttcaactggnacngtngnngggcgtnnnngcannangncaanannagccnnnggangnncantananagcncgtaccgngnnngncagcgtcctnnnnncngcncannacnggntgaanggnanggnantnnnannnnnn

SEQ ID NO: 3626 - DNA, 361 bp, Artificial Sequence
  source: /note="Description of Artificial Sequence: Synthetic polynucleotide"
  modified_base (352)..(352): a, c, t, g, unknown or other
  modified_base (354)..(354): a, c, t, g, unknown or other
caggtgcagctggtgcagtctggggctgaggtgaagaagcctggggcctcagtgaaggtttcctgcaaggcatctggatacaccttcatcagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagggcaaatgagggagcagctgtttcatttgactactggggccagggaaccctggtcaccntntcctcag

SEQ ID NO: 3627 - DNA, 1105 bp, Artificial Sequence
  source: /note="Description of Artificial Sequence: Synthetic polynucleotide"
  modified_base (1)..(14): a, c, t, g, unknown or other
  modified_base (18)..(18): a, c, t, g, unknown or other
  modified_base (20)..(21): a, c, t, g, unknown or other
  modified_base (24)..(24): a, c, t, g, unknown or other
  modified_base (26)..(26): a, c, t, g, unknown or other
  modified_base (791)..(791): a, c, t, g, unknown or other
  modified_base (851)..(851): a, c, t, g, unknown or other
  modified_base (857)..(857): a, c, t, g, unknown or other
  modified_base (981)..(981): a, c, t, g, unknown or other
  modified_base (993)..(993): a, c, t, g, unknown or other
  modified_base (1003)..(1003): a, c, t, g, unknown or other
  modified_base (1009)..(1009): a, c, t, g, unknown or other
  modified_base (1017)..(1017): a, c, t, g, unknown or other
  modified_base (1022)..(1025): a, c, t, g, unknown or other
  modified_base (1028)..(1029): a, c, t, g, unknown or other
  modified_base (1033)..(1034): a, c, t, g, unknown or other
  modified_base (1037)..(1039): a, c, t, g, unknown or other
  modified_base (1041)..(1063): a, c, t, g, unknown or other
  modified_base (1082)..(1083): a, c, t, g, unknown or other
  modified_base (1086)..(1086): a, c, t, g, unknown or other
  modified_base (1088)..(1089): a, c, t, g, unknown or other
  modified_base (1091)..(1091): a, c, t, g, unknown or other
  modified_base (1096)..(1096): a, c, t, g, unknown or other
  modified_base (1099)..(1103): a, c, t, g, unknown or other
  modified_base (1105)..(1105): a, c, t, g, unknown or other
nnnnnnnnnnnnnntgtntnnacncntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccggagggcagttttggccaggggaccaagctggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcanggcctgagctcgcccgtcacaaagagcttcaacaggggagagtgttagaagcttggccgnccatgncccaacttgtttattgcagcttataatggttacaaataaagcaatagcatcacaaatttcacaaataaagcatttttttcactgcattctagttgtggtttgtccaaactcatcaatgtatctnatcatgtctggntcgggaattnattcgncgcagcancatgnnnnaannactnngannnannnnnnnnnnnnnnnnnnnnnnntgagcgaaagaacatctgnngantnngngtcanttnnnnngn

SEQ ID NO: 3628 - DNA, 328 bp, Artificial Sequence
  source: /note="Description of Artificial Sequence: Synthetic polynucleotide"
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccggagggcagttttggccaggggaccaagctggagatcaaac

SEQ ID NO: 3629 - DNA, 1166 bp, Artificial Sequence
  source: /note="Description of Artificial Sequence: Synthetic polynucleotide"
  modified_base (1)..(11): a, c, t, g, unknown or other
  modified_base (13)..(13): a, c, t, g, unknown or other
  modified_base (15)..(16): a, c, t, g, unknown or other
  modified_base (19)..(19): a, c, t, g, unknown or other
  modified_base (1006)..(1006): a, c, t, g, unknown or other
  modified_base (1009)..(1009): a, c, t, g, unknown or other
  modified_base (1013)..(1014): a, c, t, g, unknown or other
  modified_base (1018)..(1018): a, c, t, g, unknown or other
  modified_base (1023)..(1023): a, c, t, g, unknown or other
  modified_base (1025)..(1025): a, c, t, g, unknown or other
  modified_base (1034)..(1034): a, c, t, g, unknown or other
  modified_base (1048)..(1048): a, c, t, g, unknown or other
  modified_base (1051)..(1052): a, c, t, g, unknown or other
  modified_base (1055)..(1056): a, c, t, g, unknown or other
  modified_base (1061)..(1062): a, c, t, g, unknown or other
  modified_base (1076)..(1077): a, c, t, g, unknown or other
  modified_base (1080)..(1080): a, c, t, g, unknown or other
  modified_base (1083)..(1084): a, c, t, g, unknown or other
  modified_base (1087)..(1088): a, c, t, g, unknown or other
  modified_base (1099)..(1099): a, c, t, g, unknown or other
  modified_base (1106)..(1106): a, c, t, g, unknown or other
  modified_base (1108)..(1110): a, c, t, g, unknown or other
  modified_base (1113)..(1115): a, c, t, g, unknown or other
  modified_base (1121)..(1123): a, c, t, g, unknown or other
  modified_base (1126)..(1127): a, c, t, g, unknown or other
  modified_base (1130)..(1130): a, c, t, g, unknown or other
  modified_base (1132)..(1141): a, c, t, g, unknown or other
  modified_base (1143)..(1151): a, c, t, g, unknown or other
  modified_base (1153)..(1153): a, c, t, g, unknown or other
  modified_base (1156)..(1159): a, c, t, g, unknown or other
  modified_base (1162)..(1162): a, c, t, g, unknown or other
  modified_base (1165)..(1166): a, c, t, g, unknown or other
nnnnnnnnnnnangnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggagacttggtccagcctggggggtccctgagactctcctgttcagcctctggattcaccttcagtagctatgctatgcactgggtccgccaggctccagggaagggactggaatatgtttcagttattagtaatactgggggtgacacatactacgcagactccgtgaagggcagattcaccatctccagagacaattccaagaacacgttgtatcttcaagtgagcagtctgagacctgaagacacggctgtgtattactgtgtgaaagatcaagggggccgggggtggccaagttactactactaccactacatggacgtctggggcaaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtgggnggngganntganccacnanaccctgagncaagttcaactggnacnnggnnggcgnngaggtgcataatgnnaanaannaanncgcgggaggancagtacnannngcnnntaccgnnnggnnagncnnnnnnnnnncnnnnnnnnnantgnnnnaanggnn

SEQ ID NO: 3630 - DNA, 381 bp, Artificial Sequence
  source: /note="Description of Artificial Sequence: Synthetic polynucleotide"
gaggtgcagctggtggagtctgggggagacttggtccagcctggggggtccctgagactctcctgttcagcctctggattcaccttcagtagctatgctatgcactgggtccgccaggctccagggaagggactggaatatgtttcagttattagtaatactgggggtgacacatactacgcagactccgtgaagggcagattcaccatctccagagacaattccaagaacacgttgtatcttcaagtgagcagtctgagacctgaagacacggctgtgtattactgtgtgaaagatcaagggggccgggggtggccaagttactactactaccactacatggacgtctggggcaaagggaccacggtcaccgtctcctca

SEQ ID NO: 3631 - DNA, 1154 bp, Artificial Sequence
  source: /note="Description of Artificial Sequence: Synthetic polynucleotide"
  modified_base (1)..(8): a, c, t, g, unknown or other
  modified_base (17)..(19): a, c, t, g, unknown or other
  modified_base (21)..(21): a, c, t, g, unknown or other
  modified_base (877)..(878): a, c, t, g, unknown or other
  modified_base (880)..(883): a, c, t, g, unknown or other
  modified_base (887)..(888): a, c, t, g, unknown or other
  modified_base (896)..(896): a, c, t, g, unknown or other
  modified_base (964)..(964): a, c, t, g, unknown or other
  modified_base (978)..(978): a, c, t, g, unknown or other
  modified_base (982)..(987): a, c, t, g, unknown or other
  modified_base (993)..(993): a, c, t, g, unknown or other
  modified_base (996)..(996): a, c, t, g, unknown or other
  modified_base (1004)..(1004): a, c, t, g, unknown or other
  modified_base (1010)..(1016): a, c, t, g, unknown or other
  modified_base (1020)..(1020): a, c, t, g, unknown or other
  modified_base (1022)..(1022): a, c, t, g, unknown or other
  modified_base (1024)..(1024): a, c, t, g, unknown or other
  modified_base (1026)..(1029): a, c, t, g, unknown or other
  modified_base (1034)..(1034): a, c, t, g, unknown or other
  modified_base (1038)..(1039): a, c, t, g, unknown or other
  modified_base (1044)..(1049): a, c, t, g, unknown or other
  modified_base (1051)..(1051): a, c, t, g, unknown or other
  modified_base (1053)..(1058): a, c, t, g, unknown or other
  modified_base (1064)..(1070): a, c, t, g, unknown or other
  modified_base (1072)..(1078): a, c, t, g, unknown or other
  modified_base (1082)..(1088): a, c, t, g, unknown or other
  modified_base (1090)..(1090): a, c, t, g, unknown or other
  modified_base (1092)..(1098): a, c, t, g, unknown or other
  modified_base (1101)..(1105): a, c, t, g, unknown or other
  modified_base (1107)..(1113): a, c, t, g, unknown or other
  modified_base (1116)..(1118): a, c, t, g, unknown or other
  modified_base (1121)..(1122): a, c, t, g, unknown or other
  modified_base (1124)..(1132): a, c, t, g, unknown or other
  modified_base (1135)..(1135): a, c, t, g, unknown or other
  modified_base (1137)..(1140): a, c, t, g, unknown or other
  modified_base (1142)..(1146): a, c, t, g, unknown or other
  modified_base (1149)..(1154): a, c, t, g, unknown or other
nnnnnnnnttatgtatnnncncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcagtgacattggtgattataactatgtctcctggtaccaacaccacccaggcaaagcccccaaactcatgatttatgaagtcagtaatcggccctcaggggtttctaatcgcttctctggctccaagtctggcaacacggcctccctgaccatctctgggctccaggctgaggacgagactgattattactgcatctcatatacaagcagcagcactcttccctatgtcttcggaactgggaccaaggtcaccgtcctaggtcagcccaaggccaaccccactgtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgtnncnnnntatnntgattacnaaataaagcaatagcatcacaaatttcacaaataaagcatttttttcactgcattctagttgtggttngtccaaactcatcnatgnnnnnnttatcntgnctggatcnggaatnnnnnnngcancncntnnnnaaatnaccnntgaannnnnnantnnnnnngtactnnnnnnngnnnnnnnaacnnnnnnngnannnnnnngtnnnnntnnnnnnnaannnccnngnnnnnnnnnggnannnntnnnnnaannnnnn

SEQ ID NO: 3632 - DNA, 337 bp, Artificial Sequence
  source: /note="Description of Artificial Sequence: Synthetic polynucleotide"
cagtctgccctgactcagcctgcctccgtgtctgggtctcctggacagtcgatcaccatctcctgcactggaaccagcagtgacattggtgattataactatgtctcctggtaccaacaccacccaggcaaagcccccaaactcatgatttatgaagtcagtaatcggccctcaggggtttctaatcgcttctctggctccaagtctggcaacacggcctccctgaccatctctgggctccaggctgaggacgagactgattattactgcatctcatatacaagcagcagcactcttccctatgtcttcggaactgggaccaaggtcaccgtcctag

SEQ ID NO: 3633 - DNA, 1136 bp, Artificial Sequence
  source: /note="Description of Artificial Sequence: Synthetic polynucleotide"
  modified_base (1)..(7): a, c, t, g, unknown or other
  modified_base (9)..(10): a, c, t, g, unknown or other
  modified_base (18)..(18): a, c, t, g, unknown or other
  modified_base (22)..(22): a, c, t, g, unknown or other
  modified_base (844)..(844): a, c, t, g, unknown or other
  modified_base (846)..(846): a, c, t, g, unknown or other
  modified_base (962)..(964): a, c, t, g, unknown or other
  modified_base (975)..(977): a, c, t, g, unknown or other
  modified_base (982)..(982): a, c, t, g, unknown or other
  modified_base (988)..(988): a, c, t, g, unknown or other
  modified_base (1005)..(1005): a, c, t, g, unknown or other
  modified_base (1017)..(1017): a, c, t, g, unknown or other
  modified_base (1025)..(1025): a, c, t, g, unknown or other
  modified_base (1034)..(1034): a, c, t, g, unknown or other
  modified_base (1048)..(1048): a, c, t, g, unknown or other
  modified_base (1051)..(1052): a, c, t, g, unknown or other
  modified_base (1055)..(1056): a, c, t, g, unknown or other
  modified_base (1060)..(1065): a, c, t, g, unknown or other
  modified_base (1072)..(1072): a, c, t, g, unknown or other
  modified_base (1074)..(1075): a, c, t, g, unknown or other
  modified_base (1077)..(1077): a, c, t, g, unknown or other
  modified_base (1080)..(1081): a, c, t, g, unknown or other
  modified_base (1088)..(1089): a, c, t, g, unknown or other
  modified_base (1092)..(1092): a, c, t, g, unknown or other
  modified_base (1097)..(1097): a, c, t, g, unknown or other
  modified_base (1100)..(1107): a, c, t, g, unknown or other
  modified_base (1111)..(1111): a, c, t, g, unknown or other
  modified_base (1114)..(1115): a, c, t, g, unknown or other
  modified_base (1119)..(1119): a, c, t, g, unknown or other
  modified_base (1121)..(1125): a, c, t, g, unknown or other
  modified_base (1128)..(1130): a, c, t, g, unknown or other
  modified_base (1134)..(1136): a, c, t, g, unknown or other
nnnnnnncnnatgtatcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggttcagctggtgcagtctggagctgaggtgaagaagcctggggcctcagtgaaggtcccctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagttcccgcctcgtacggtgacgacgattactactactactacggtatggacgtctggggccaagggaccacggtcaccgtctcctcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnangtggacaagagagttgagcccaaatcttgtgacaaaactcacacatgcccaccgtgcccagcacctgaactcctggggggaccgtcagtcttcctcttccccccaaaacccaaggnnnccctcatgatnnncccgnaccccngaggtcacatgcgtggnggtggacgtganccacgaanaccctgagncaagttcaactggnacnnggnnggcnnnnnngcataangnnanaannaagccgnnggnaggancannnnnnnnagcncgnnccgngnnnnncannnttcnnn

SEQ ID NO: 3634 - skipped

SEQ ID NO: 3635 - DNA, 1145 bp, Artificial Sequence
  source: /note="Description of Artificial Sequence: Synthetic polynucleotide"
  modified_base (1)..(7): a, c, t, g, unknown or other
  modified_base (16)..(16): a, c, t, g, unknown or other
  modified_base (22)..(22): a, c, t, g, unknown or other
  modified_base (814)..(814): a, c, t, g, unknown or other
  modified_base (816)..(820): a, c, t, g, unknown or other
  modified_base (968)..(969): a, c, t, g, unknown or other
  modified_base (985)..(985): a, c, t, g, unknown or other
  modified_base (991)..(991): a, c, t, g, unknown or other
  modified_base (995)..(995): a, c, t, g, unknown or other
  modified_base (1000)..(1000): a, c, t, g, unknown or other
  modified_base (1002)..(1003): a, c, t, g, unknown or other
  modified_base (1009)..(1011): a, c, t, g, unknown or other
  modified_base (1014)..(1016): a, c, t, g, unknown or other
  modified_base (1020)..(1021): a, c, t, g, unknown or other
  modified_base (1023)..(1025): a, c, t, g, unknown or other
  modified_base (1034)..(1035): a, c, t, g, unknown or other
  modified_base (1037)..(1041): a, c, t, g, unknown or other
  modified_base (1043)..(1044): a, c, t, g, unknown or other
  modified_base (1053)..(1053): a, c, t, g, unknown or other
  modified_base (1057)..(1057): a, c, t, g, unknown or other
  modified_base (1060)..(1060): a, c, t, g, unknown or other
  modified_base (1063)..(1066): a, c, t, g, unknown or other
  modified_base (1069)..(1073): a, c, t, g, unknown or other
  modified_base (1078)..(1078): a, c, t, g, unknown or other
  modified_base (1080)..(1084): a, c, t, g, unknown or other
  modified_base (1088)..(1088): a, c, t, g, unknown or other
  modified_base (1096)..(1096): a, c, t, g, unknown or other
  modified_base (1101)..(1104): a, c, t, g, unknown or other
  modified_base (1107)..(1110): a, c, t, g, unknown or other
  modified_base (1112)..(1113): a, c, t, g, unknown or other
  modified_base (1115)..(1125): a, c, t, g, unknown or other
  modified_base (1127)..(1129): a, c, t, g, unknown or other
  modified_base (1132)..(1132): a, c, t, g, unknown or other
  modified_base (1134)..(1136): a, c, t, g, unknown or other
  modified_base (1140)..(1145): a, c, t, g, unknown or other
nnnnnnntatgtatcntacacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttctgtgacctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtactctttgggtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggccccnannnnnaatgttcatagaagcttggcccgccatggcccaacttgtttattgcagcttataatggttacaaataaagcaatagcatcacaaatttcacaaataaagcatttttttcactgcattctagttgtggtttgtccaaactcatcaatgnntcttatcatgtctggntcgggnattnatttngnngcagcnnntgnnngaannannntgaaagagnntnnnnngnncttctgagngaanacntcnnnngannnnngtcantnnnnngaangtcccagntcccnnnnggnnnntnngnnnnnnnnnnntnnncantnnntcannnnnn

SEQ ID NO: 3636 - DNA, 325 bp, Artificial Sequence
  source: /note="Description of Artificial Sequence: Synthetic polynucleotide"
tcctatgtgctgactcagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtactctttgggtgttcggcggagggaccaagctgaccgtcctag

SEQ ID NO: 3637 - DNA, 1120 bp, Artificial Sequence
  source: /note="Description of Artificial Sequence: Synthetic polynucleotide"
  modified_base (1)..(8): a, c, t, g, unknown or other
  modified_base (10)..(11): a, c, t, g, unknown or other
  modified_base (19)..(19): a, c, t, g, unknown or other
  modified_base (23)..(23): a, c, t, g, unknown or other
  modified_base (25)..(25): a, c, t, g, unknown or other
  modified_base (964)..(966): a, c, t, g, unknown or other
  modified_base (979)..(979): a, c, t, g, unknown or other
  modified_base (983)..(985): a, c, t, g, unknown or other
  modified_base (989)..(989): a, c, t, g, unknown or other
  modified_base (1012)..(1013): a, c, t, g, unknown or other
  modified_base (1020)..(1022): a, c, t, g, unknown or other
  modified_base (1029)..(1029): a, c, t, g, unknown or other
  modified_base (1033)..(1033): a, c, t, g, unknown or other
  modified_base (1037)..(1038): a, c, t, g, unknown or other
  modified_base (1040)..(1041): a, c, t, g, unknown or other
  modified_base (1044)..(1046): a, c, t, g, unknown or other
  modified_base (1048)..(1048): a, c, t, g, unknown or other
  modified_base (1053)..(1053): a, c, t, g, unknown or other
  modified_base (1061)..(1061): a, c, t, g, unknown or other
  modified_base (1065)..(1065): a, c, t, g, unknown or other
  modified_base (1067)..(1068): a, c, t, g, unknown or other
  modified_base (1074)..(1076): a, c, t, g, unknown or other
  modified_base (1079)..(1079): a, c, t, g, unknown or other
  modified_base (1088)..(1091): a, c, t, g, unknown or other
  modified_base (1093)..(1093): a, c, t, g, unknown or other
  modified_base (1098)..(1099): a, c, t, g, unknown or other
  modified_base (1107)..(1114): a, c, t, g, unknown or other
  modified_base (1116)..(1116): a, c, t, g, unknown or other
  modified_base (1118)..(1120): a, c, t, g, unknown or other
nnnnnnnncnnatgtatcntacncntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtctctcacctgcgctgtctctggtgggtcactcagtggtttctactggacctggatccgccagccccccggaaaggggctggagtggattggggaaaccaatcattttggaagcaccgactacaagccgtccctcaagagtcgagtcaccatatcagtagacatgtccaggaaccaattttccctgattatgacctctgtgaccgccgcggacacggctgtgtattactgtgcgagaaagaccctcctcttcagtgacttttctcctggtgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatnnnccggacccctgangtcnnntgcntggtggtggacgtgagccacgannaccctgnnncagtcantggnacgnngnnggnnngnaggtncataatgncaanannaagccnnnggnaggagcagnnnnancagcnncgtacccnnnnnnnnancnnn

SEQ ID NO: 3638 - DNA, 370 bp, Artificial Sequence
  source: /note="Description of Artificial Sequence: Synthetic polynucleotide"
caggtgcagctacagcagtggggcgcaggactgttgaagccttcggagaccctgtctctcacctgcgctgtctctggtgggtcactcagtggtttctactggacctggatccgccagccccccggaaaggggctggagtggattggggaaaccaatcattttggaagcaccgactacaagccgtccctcaagagtcgagtcaccatatcagtagacatgtccaggaaccaattttccctgattatgacctctgtgaccgccgcggacacggctgtgtattactgtgcgagaaagaccctcctcttcagtgacttttctcctggtgcttttgatatctggggccaagggacaatggtcgtagtctcttcag

SEQ ID NO: 3639 - DNA, 1089 bp, Artificial Sequence
  source: /note="Description of Artificial Sequence: Synthetic polynucleotide"
  modified_base (1)..(11): a, c, t, g, unknown or other
  modified_base (16)..(17): a, c, t, g, unknown or other
  modified_base (20)..(20): a, c, t, g, unknown or other
  modified_base (24)..(24): a, c, t, g, unknown or other
  modified_base (828)..(828): a, c, t, g, unknown or other
  modified_base (830)..(834): a, c, t, g, unknown or other
  modified_base (842)..(842): a, c, t, g, unknown or other
  modified_base (847)..(847): a, c, t, g, unknown or other
  modified_base (850)..(850): a, c, t, g, unknown or other
  modified_base (853)..(853): a, c, t, g, unknown or other
  modified_base (858)..(858): a, c, t, g, unknown or other
  modified_base (860)..(863): a, c, t, g, unknown or other
  modified_base (867)..(867): a, c, t, g, unknown or other
  modified_base (869)..(876): a, c, t, g, unknown or other
  modified_base (878)..(885): a, c, t, g, unknown or other
  modified_base (887)..(887): a, c, t, g, unknown or other
  modified_base (903)..(903): a, c, t, g, unknown or other
  modified_base (908)..(908): a, c, t, g, unknown or other
  modified_base (911)..(912): a, c, t, g, unknown or other
  modified_base (916)..(916): a, c, t, g, unknown or other
  modified_base (924)..(927): a, c, t, g, unknown or other
  modified_base (935)..(935): a, c, t, g, unknown or other
  modified_base (945)..(947): a, c, t, g, unknown or other
  modified_base (951)..(951): a, c, t, g, unknown or other
  modified_base (953)..(953): a, c, t, g, unknown or other
  modified_base (971)..(973): a, c, t, g, unknown or other
  modified_base (976)..(977): a, c, t, g, unknown or other
  modified_base (982)..(982): a, c, t, g, unknown or other
  modified_base (984)..(984): a, c, t, g, unknown or other
  modified_base (986)..(986): a, c, t, g, unknown or other
  modified_base (991)..(992): a, c, t, g, unknown or other
  modified_base (994)..(996): a, c, t, g, unknown or other
  modified_base (998)..(998): a, c, t, g, unknown or other
  modified_base (1002)..(1002): a, c, t, g, unknown or other
  modified_base (1006)..(1006): a, c, t, g, unknown or other
  modified_base (1008)..(1011): a, c, t, g, unknown or other
  modified_base (1013)..(1019): a, c, t, g, unknown or other
  modified_base (1021)..(1021): a, c, t, g, unknown or other
  modified_base (1023)..(1024): a, c, t, g, unknown or other
  modified_base (1027)..(1027): a, c, t, g, unknown or other
  modified_base (1030)..(1032): a, c, t, g, unknown or other
  modified_base (1038)..(1043): a, c, t, g, unknown or other
  modified_base (1045)..(1045): a, c, t, g, unknown or other
  modified_base (1048)..(1048): a, c, t, g, unknown or other
  modified_base (1051)..(1051): a, c, t, g, unknown or other
  modified_base (1054)..(1054): a, c, t, g, unknown or other
  modified_base (1056)..(1056): a, c, t, g, unknown or other
  modified_base (1059)..(1059): a, c, t, g, unknown or other
  modified_base (1061)..(1064): a, c, t, g, unknown or other
  modified_base (1069)..(1069): a, c, t, g, unknown or other
  modified_base (1072)..(1072): a, c, t, g, unknown or other
  modified_base (1074)..(1075): a, c, t, g, unknown or other
  modified_base (1078)..(1078): a, c, t, g, unknown or other
  modified_base (1084)..(1084): a, c, t, g, unknown or other
  modified_base (1086)..(1089): a, c, t, g, unknown or other
nnnnnnnnnnntatgnntcntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagactcttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatggtactacacctcggactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacagggganannnnngaagcttnggccnccntgngcccncnnnntgtntnnnnnnnntnnnnnnnntnacaaataaagcaatancatcncannttcncaaaaaannnntttttttntcactgcatnnngtgngnttgtccaactcatcatgnnnctnncatgncngntcggnntnnngngcancacntnnnnannnnnnngnanngantgnnngtactnnnnnngnaanacntcngngangnnnncagtnggngnngangtcccngnnnn

SEQ ID NO: 3640 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactcttaccgccaactacttagcctggtaccagcagaaacctggccaggctcccagactcctcatctatggtgcatccaagagggccactggcatcccagacaggttcagtggcagtgggtctgggacagacttcactctcagcatcagcagactggagcctgaagattttgcagtgtattactgtcagcagtatggtactacacctcggactttcggcggagggaccaaggtggagatcaa

SEQ ID NO: 3641 - DNA, 1131 bp, Artificial Sequence
  source: /note="Description of Artificial Sequence: Synthetic polynucleotide"
  modified_base (1)..(9): a, c, t, g, unknown or other
  modified_base (13)..(13): a, c, t, g, unknown or other
  modified_base (17)..(17): a, c, t, g, unknown or other
  modified_base (951)..(952): a, c, t, g, unknown or other
  modified_base (976)..(978): a, c, t, g, unknown or other
  modified_base (989)..(992): a, c, t, g, unknown or other
  modified_base (1008)..(1008): a, c, t, g, unknown or other
  modified_base (1010)..(1010): a, c, t, g, unknown or other
  modified_base (1016)..(1016): a, c, t, g, unknown or other
  modified_base (1024)..(1024): a, c, t, g, unknown or other
  modified_base (1028)..(1028): a, c, t, g, unknown or other
  modified_base (1032)..(1033): a, c, t, g, unknown or other
  modified_base (1035)..(1036): a, c, t, g, unknown or other
  modified_base (1040)..(1045): a, c, t, g, unknown or other
  modified_base (1051)..(1052): a, c, t, g, unknown or other
  modified_base (1054)..(1055): a, c, t, g, unknown or other
  modified_base (1057)..(1057): a, c, t, g, unknown or other
  modified_base (1062)..(1064): a, c, t, g, unknown or other
  modified_base (1068)..(1068): a, c, t, g, unknown or other
  modified_base (1071)..(1071): a, c, t, g, unknown or other
  modified_base (1074)..(1074): a, c, t, g, unknown or other
  modified_base (1077)..(1077): a, c, t, g, unknown or other
  modified_base (1079)..(1079): a, c, t, g, unknown or other
  modified_base (1091)..(1091): a, c, t, g, unknown or other
  modified_base (1093)..(1095): a, c, t, g, unknown or other
  modified_base (1103)..(1103): a, c, t, g, unknown or other
  modified_base (1105)..(1107): a, c, t, g, unknown or other
  modified_base (1111)..(1111): a, c, t, g, unknown or other
  modified_base (1113)..(1114): a, c, t, g, unknown or other
  modified_base (1117)..(1117): a, c, t, g, unknown or other
  modified_base (1120)..(1120): a, c, t, g, unknown or other
  modified_base (1123)..(1124): a, c, t, g, unknown or other
  modified_base (1130)..(1131): a, c, t, g, unknown or other
nnnnnnnnnatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaaggcgtccctcaagagtcgagtcaccatatcagtaggcatgtccaggaaccaattttccctgaaggtgacttctctgaccgccgcggacacggctgtgtattactgcgcgagaaagcccctcctctacagtgacttttctcctggtgcttttgatgtctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacnncctcatgatctcccggacccctgnnncacatgcgtgnnnngacgtgagccacgaanancctgantcagtcantggnacgnngnnggcnnnnnngcatanncnnanaagcnnnggangancantananagcacgtaccgngnnncagcgtcntnnngtcngnnccngantgnngaatgnn

SEQ ID NO: 3642 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaaggcgtccctcaagagtcgagtcaccatatcagtaggcatgtccaggaaccaattttccctgaaggtgacttctctgaccgccgcggacacggctgtgtattactgtgcgagaaagcccctcctctacagtgacttttctcctggtgcttttgatatctggggccaagggacaatgatcgtagtctcttcag

SEQ ID NO: 3643 - DNA, 1102 bp, Artificial Sequence
  source: /note="Description of Artificial Sequence: Synthetic polynucleotide"
  modified_base (1)..(12): a, c, t, g, unknown or other
  modified_base (16)..(16): a, c, t, g, unknown or other
  modified_base (19)..(21): a, c, t, g, unknown or other
  modified_base (25)..(25): a, c, t, g, unknown or other
  modified_base (882)..(882): a, c, t, g, unknown or other
  modified_base (951)..(951): a, c, t, g, unknown or other
  modified_base (953)..(953): a, c, t, g, unknown or other
  modified_base (971)..(971): a, c, t, g, unknown or other
  modified_base (993)..(998): a, c, t, g, unknown or other
  modified_base (1001)..(1003): a, c, t, g, unknown or other
  modified_base (1008)..(1015): a, c, t, g, unknown or other
  modified_base (1018)..(1024): a, c, t, g, unknown or other
  modified_base (1029)..(1032): a, c, t, g, unknown or other
  modified_base (1035)..(1035): a, c, t, g, unknown or other
  modified_base (1037)..(1038): a, c, t, g, unknown or other
  modified_base (1044)..(1044): a, c, t, g, unknown or other
  modified_base (1050)..(1050): a, c, t, g, unknown or other
  modified_base (1054)..(1054): a, c, t, g, unknown or other
  modified_base (1058)..(1058): a, c, t, g, unknown or other
  modified_base (1061)..(1061): a, c, t, g, unknown or other
  modified_base (1063)..(1065): a, c, t, g, unknown or other
  modified_base (1067)..(1074): a, c, t, g, unknown or other
  modified_base (1083)..(1087): a, c, t, g, unknown or other
  modified_base (1096)..(1097): a, c, t, g, unknown or other
  modified_base (1100)..(1101): a, c, t, g, unknown or other
nnnnnnnnnnnnatgnatnnncacntacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagactcttaccgccaactacttagcctggtaccagcagaaacctggccaggctcccagactcctcatctatggtgcatccaagagggccgctggcatcccagacaggttcagtggcagtgggtctgggacagacttcactctcagcatcaccagactggagcctgaagattttgcagtgtattactgtcagcagtatcatactacacctcggactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggntacaaataaagcaatagcatcacaaatttcacaaataaagcatttttttcactgcattctagttgtggntngtccaaactcatcaatgnatcttatcatgtctggatcggnnnnnncgnnncagcnnnnnnnnaannnnnnntgaannnnctngnngtactnctgagngaanaacntcngnnnannnnnnnncagtagggnnnnngaagtcccnnggnnc

SEQ ID NO: 3644 - skipped

SEQ ID NO: 3645 - DNA, 1173 bp, Artificial Sequence
  source: /note="Description of Artificial Sequence: Synthetic polynucleotide"
  modified_base (1)..(8): a, c, t, g, unknown or other
  modified_base (10)..(10): a, c, t, g, unknown or other
  modified_base (13)..(13): a, c, t, g, unknown or other
  modified_base (17)..(17): a, c, t, g, unknown or other
  modified_base (833)..(833): a, c, t, g, unknown or other
  modified_base (837)..(837): a, c, t, g, unknown or other
  modified_base (855)..(856): a, c, t, g, unknown or other
  modified_base (868)..(868): a, c, t, g, unknown or other
  modified_base (882)..(882): a, c, t, g, unknown or other
  modified_base (884)..(884): a, c, t, g, unknown or other
  modified_base (891)..(891): a, c, t, g, unknown or other
  modified_base (893)..(894): a, c, t, g, unknown or other
  modified_base (902)..(904): a, c, t, g, unknown or other
  modified_base (907)..(909): a, c, t, g, unknown or other
  modified_base (916)..(920): a, c, t, g, unknown or other
  modified_base (923)..(924): a, c, t, g, unknown or other
  modified_base (951)..(951): a, c, t, g, unknown or other
  modified_base (953)..(954): a, c, t, g, unknown or other
  modified_base (956)..(956): a, c, t, g, unknown or other
  modified_base (961)..(961): a, c, t, g, unknown or other
  modified_base (976)..(976): a, c, t, g, unknown or other
  modified_base (1003)..(1003): a, c, t, g, unknown or other
  modified_base (1014)..(1014): a, c, t, g, unknown or other
  modified_base (1019)..(1019): a, c, t, g, unknown or other
  modified_base (1025)..(1025): a, c, t, g, unknown or other
  modified_base (1027)..(1029): a, c, t, g, unknown or other
  modified_base (1033)..(1033): a, c, t, g, unknown or other
  modified_base (1038)..(1038): a, c, t, g, unknown or other
  modified_base (1042)..(1042): a, c, t, g, unknown or other
  modified_base (1045)..(1047): a, c, t, g, unknown or other
  modified_base (1049)..(1049): a, c, t, g, unknown or other
  modified_base (1057)..(1057): a, c, t, g, unknown or other
  modified_base (1060)..(1060): a, c, t, g, unknown or other
  modified_base (1065)..(1065): a, c, t, g, unknown or other
  modified_base (1067)..(1067): a, c, t, g, unknown or other
  modified_base (1069)..(1070): a, c, t, g, unknown or other
  modified_base (1073)..(1073): a, c, t, g, unknown or other
  modified_base (1075)..(1075): a, c, t, g, unknown or other
  modified_base (1078)..(1079): a, c, t, g, unknown or other
  modified_base (1081)..(1083): a, c, t, g, unknown or other
  modified_base (1087)..(1087): a, c, t, g, unknown or other
  modified_base (1089)..(1090): a, c, t, g, unknown or other
  modified_base (1092)..(1092): a, c, t, g, unknown or other
  modified_base (1095)..(1095): a, c, t, g, unknown or other
  modified_base (1098)..(1098): a, c, t, g, unknown or other
  modified_base (1104)..(1104): a, c, t, g, unknown or other
  modified_base (1107)..(1109): a, c, t, g, unknown or other
  modified_base (1111)..(1116): a, c, t, g, unknown or other
  modified_base (1119)..(1125): a, c, t, g, unknown or other
  modified_base (1127)..(1127): a, c, t, g, unknown or other
  modified_base (1129)..(1131): a, c, t, g, unknown or other
  modified_base (1133)..(1135): a, c, t, g, unknown or other
  modified_base (1137)..(1138): a, c, t, g, unknown or other
  modified_base (1140)..(1145): a, c, t, g, unknown or other
  modified_base (1147)..(1147): a, c, t, g, unknown or other
  modified_base (1149)..(1149): a, c, t, g, unknown or other
  modified_base (1151)..(1155): a, c, t, g, unknown or other
  modified_base (1157)..(1157): a, c, t, g, unknown or other
  modified_base (1162)..(1168): a, c, t, g, unknown or other
  modified_base (1170)..(1173): a, c, t, g, unknown or other
nnnnnnnntntgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaagccgtccctcaagagtcgagtcaccatatcagtagacatgtccaggaaccagttctccctgaaggtgacctctgtgaccgccgcggacacggctgtttattactgtgcgagaaagcccctcctccacagtgacttatctcctggtgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaangtgnacaagagagttgagcccnnatcttgtgacanaactcacacatgcncnccgtgcncnncacctgannnccnnngggggannnnncanngttcttcttcctcctcccccccaaaancnnangacancctcatgatctcccngacccctgaggtcacatgcgtggtggnggacgtgagcnacgangacccngnnncaanttcantggnacnnngncggcgtgnagntgcanangnnaananaanncnnngggnannancantanacagcncgnnncnnnnnnggnnnnnnncntnnncnnncnncnnnnnngnantnnnnngnaatgnnnnnnnannnn

SEQ ID NO: 3646 - DNA, 370 bp, Artificial Sequence
  source: /note="Description of Artificial Sequence: Synthetic polynucleotide"
caggtgcagctacagcagtggggcgcaggactgttgaagccttcggagaccctgtccctcacctgcgctgtctctggtgggtcactcagtggtttctactggacctggatccgccagcccccaggaaaggggctggagtggattggggaaaccaatcattttggaagcaccgactacaagccgtccctcaagagtcgagtcaccatatcagtagacatgtccaggaaccagttctccctgaaggtgacctctgtgaccgccgcggacacggctgtttattactgtgcgagaaagcccctcctccacagtgacttatctcctggtgcttttgatatctggggccaagggacaatggtcgccgtctcttcag

SEQ ID NO: 3647 - DNA, 1145 bp, Artificial Sequence
  source: /note="Description of Artificial Sequence: Synthetic polynucleotide"
  modified_base (1)..(9): a, c, t, g, unknown or other
  modified_base (14)..(14): a, c, t, g, unknown or other
  modified_base (18)..(18): a, c, t, g, unknown or other
  modified_base (987)..(987): a, c, t, g, unknown or other
  modified_base (1010)..(1010): a, c, t, g, unknown or other
  modified_base (1012)..(1012): a, c, t, g, unknown or other
  modified_base (1015)..(1017): a, c, t, g, unknown or other
  modified_base (1020)..(1020): a, c, t, g, unknown or other
  modified_base (1025)..(1027): a, c, t, g, unknown or other
  modified_base (1035)..(1036): a, c, t, g, unknown or other
  modified_base (1038)..(1045): a, c, t, g, unknown or other
  modified_base (1047)..(1049): a, c, t, g, unknown or other
  modified_base (1054)..(1054): a, c, t, g, unknown or other
  modified_base (1058)..(1058): a, c, t, g, unknown or other
  modified_base (1061)..(1061): a, c, t, g, unknown or other
  modified_base (1065)..(1066): a, c, t, g, unknown or other
  modified_base (1069)..(1073): a, c, t, g, unknown or other
  modified_base (1078)..(1078): a, c, t, g, unknown or other
  modified_base (1080)..(1080): a, c, t, g, unknown or other
  modified_base (1083)..(1084): a, c, t, g, unknown or other
  modified_base (1086)..(1089): a, c, t, g, unknown or other
  modified_base (1097)..(1099): a, c, t, g, unknown or other
  modified_base (1103)..(1106): a, c, t, g, unknown or other
  modified_base (1108)..(1108): a, c, t, g, unknown or other
  modified_base (1110)..(1110): a, c, t, g, unknown or other
  modified_base (1113)..(1115): a, c, t, g, unknown or other
  modified_base (1118)..(1118): a, c, t, g, unknown or other
  modified_base (1122)..(1131): a, c, t, g, unknown or other
  modified_base (1133)..(1138): a, c, t, g, unknown or other
  modified_base (1141)..(1145): a, c, t, g, unknown or other
nnnnnnnnntatgnatcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagactgtttccgccaactacttagcctggtaccagcagaaagctggccaggctcccagactcctcatctatggtgcatccaagagggccactggcatcccagacaggttcagtggcagtgggtctgggacagacttcactctcagcatcagcagactggagcctgaagattttgctgtgtattactgtcagcagtatgttactacacctcggactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggntcgggaattaattcggcgcagcncntgnnntgnaatannntgaaagannannnnnnnnannntgagngaanacntctnngannnnngtcantnggnngnnnngtcccagnnncccnnnngnanaannntgnaagnnnnnnnnnntnnnnnncannnnn

SEQ ID NO: 3648 - DNA, 323 bp, Artificial Sequence
  source: /note="Description of Artificial Sequence: Synthetic polynucleotide"
gaaattgtgttgacgcagtctccaggcaccctgtctttgtctccaggggaaagagccaccctctcctgcagggccagtcagactgtttccgccaactacttagcctggtaccagcagaaagctggccaggctcccagactcctcatctatggtgcatccaagagggccactggcatcccagacaggttcagtggcagtgggtctgggacagacttcactctcagcatcagcagactggagcctgaagattttgctgtgtattactgtcagcagtatgttactacacctcggactttcggcggagggaccaaggtggagatcaa

SEQ ID NO: 3649 - DNA, 1076 bp, Artificial Sequence
  source: /note="Description of Artificial Sequence: Synthetic polynucleotide"
  modified_base (1)..(15): a, c, t, g, unknown or other
  modified_base (18)..(18): a, c, t, g, unknown or other
  modified_base (841)..(841): a, c, t, g, unknown or other
  modified_base (854)..(854): a, c, t, g, unknown or other
  modified_base (861)..(861): a, c, t, g, unknown or other
  modified_base (863)..(863): a, c, t, g, unknown or other
  modified_base (871)..(871): a, c, t, g, unknown or other
  modified_base (874)..(875): a, c, t, g, unknown or other
  modified_base (878)..(878): a, c, t, g, unknown or other
  modified_base (884)..(886): a, c, t, g, unknown or other
  modified_base (892)..(896): a, c, t, g, unknown or other
  modified_base (900)..(901): a, c, t, g, unknown or other
  modified_base (909)..(915): a, c, t, g, unknown or other
  modified_base (917)..(917): a, c, t, g, unknown or other
  modified_base (919)..(927): a, c, t, g, unknown or other
  modified_base (937)..(937): a, c, t, g, unknown or other
  modified_base (941)..(941): a, c, t, g, unknown or other
  modified_base (944)..(945): a, c, t, g, unknown or other
  modified_base (951)..(957): a, c, t, g, unknown or other
  modified_base (963)..(963): a, c, t, g, unknown or other
  modified_base (969)..(971): a, c, t, g, unknown or other
  modified_base (974)..(979): a, c, t, g, unknown or other
  modified_base (981)..(982): a, c, t, g, unknown or other
  modified_base (984)..(985): a, c, t, g, unknown or other
  modified_base (988)..(992): a, c, t, g, unknown or other
  modified_base (994)..(998): a, c, t, g, unknown or other
  modified_base (1001)..(1004): a, c, t, g, unknown or other
  modified_base (1006)..(1006): a, c, t, g, unknown or other
  modified_base (1010)..(1015): a, c, t, g, unknown or other
  modified_base (1017)..(1017): a, c, t, g, unknown or other
  modified_base (1020)..(1021): a, c, t, g, unknown or other
  modified_base (1023)..(1024): a, c, t, g, unknown or other
  modified_base (1026)..(1028): a, c, t, g, unknown or other
  modified_base (1035)..(1038): a, c, t, g, unknown or other
  modified_base (1042)..(1043): a, c, t, g, unknown or other
  modified_base (1047)..(1050): a, c, t, g, unknown or other
  modified_base (1056)..(1056): a, c, t, g, unknown or other
  modified_base (1062)..(1063): a, c, t, g, unknown or other
  modified_base (1067)..(1070): a, c, t, g, unknown or other
  modified_base (1072)..(1072): a, c, t, g, unknown or other
  modified_base (1074)..(1076): a, c, t, g, unknown or other
nnnnnnnnnnnnnnntcntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattctgaggtgcagctggtggagtctgggggaggcttggtccagccgggggggtccctgagactctcctgtgcagcctctggattcagtgtcagcaccaagtacatgacatgggtccgtcaggctccagggaaggggctggagtgggtctcagttctttacagcggtggtagtgattactacgcagactccgtgaagggcagattcaccatctccagagacaattccaagaacgctttatatcttcaaatgaacagcttgagagtcgaggacacgggtgtttattactgtgccagagactcgtcggaagtccgtgaccaccccgggcacccagggcgctcggtgggggcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccngcaacacccaagnggacaananagatgagnccnnatnttgtgnnnaaaatnnnnnatgnnctccccgnnnnnnncnannnnnnnnngggggggggnaacnttnntctttnnnnnnncccccnaaaaannnaannnnnncnntnntgnnnnncnnnnnccnnnnangtcnnnnnngnggnngnngnnngtgaccnnnnaaanncctnnnngtcaanttcaannggtnnnngnannn

SEQ ID NO: 3650 - DNA, 1128 bp, Artificial Sequence
  source: /note="Description of Artificial Sequence: Synthetic polynucleotide"
  modified_base (1)..(8): a, c, t, g, unknown or other
  modified_base (13)..(13): a, c, t, g, unknown or other
  modified_base (16)..(17): a, c, t, g, unknown or other
  modified_base (1019)..(1019): a, c, t, g, unknown or other
  modified_base (1028)..(1028): a, c, t, g, unknown or other
  modified_base (1047)..(1047): a, c, t, g, unknown or other
  modified_base (1062)..(1062): a, c, t, g, unknown or other
  modified_base (1069)..(1070): a, c, t, g, unknown or other
  modified_base (1079)..(1080): a, c, t, g, unknown or other
  modified_base (1086)..(1087): a, c, t, g, unknown or other
  modified_base (1093)..(1093): a, c, t, g, unknown or other
  modified_base (1102)..(1103): a, c, t, g, unknown or other
  modified_base (1117)..(1119): a, c, t, g, unknown or other
  modified_base (1123)..(1128): a, c, t, g, unknown or other
nnnnnnnntatgnatnntacacatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggttcctgggcccagtctgccctgactcagcctgcctccgtgtctgggtctcctggacagtcgatcaccatctcctgcactggaaccagcaatgatgttgggagttatacccttgtctcctggtaccaacagtacccaggcaaagcccccaagctcttaatttttgaggtcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctaggtcagcccaaggctgccccctcggtcactctgttcccaccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatagaagcttggccgccatggcccaacttgtttattgcagcttataatggttacaaataaagcaatagcatcacaaatttcacaaataaagcatttttttcactgcattctagttgtggtttgtccaaactcatcaatgtatcttatcatgtctggatcgggaattaattcggcgcagcaccatggnctgaaatanctctgaaagaggacttggntaggtaccttctgancggaaannaccatctgnngaatgnntgtcanttagggtgnngaaagtccccaggnnncccnnnnnn

SEQ ID NO: 3651 - DNA, 331 bp, Artificial Sequence
  source: /note="Description of Artificial Sequence: Synthetic polynucleotide"
cagtctgtgctgactcagcctgcctccgtgtctgggtctcctggacagtcgatcaccatctcctgcactggaaccagcaatgatgttgggagttatacccttgtctcctggtaccaacagtacccaggcaaagcccccaagctcttaatttttgaggtcactaagcggtcctcagggatttctaatcgcttctctggttccaagtctggcaacacggcctccctgacaatctctgggctccagggtgaagacgaggctgattattattgctgctcatatgcaggtgctagcactttcgtgttcggcggagggaccaagctgaccgtcctag

SEQ ID NO: 3652 - DNA, 1122 bp, Artificial Sequence
  source: /note="Description of Artificial Sequence: Synthetic polynucleotide"
  modified_base (1)..(20): a, c, t, g, unknown or other
  modified_base (24)..(24): a, c, t, g, unknown or other
  modified_base (831)..(833): a, c, t, g, unknown or other
  modified_base (929)..(930): a, c, t, g, unknown or other
  modified_base (943)..(943): a, c, t, g, unknown or other
  modified_base (947)..(947): a, c, t, g, unknown or other
  modified_base (959)..(959): a, c, t, g, unknown or other
  modified_base (963)..(963): a, c, t, g, unknown or other
  modified_base (966)..(966): a, c, t, g, unknown or other
  modified_base (973)..(973): a, c, t, g, unknown or other
  modified_base (975)..(975): a, c, t, g, unknown or other
  modified_base (977)..(977): a, c, t, g, unknown or other
  modified_base (979)..(979): a, c, t, g, unknown or other
  modified_base (986)..(987): a, c, t, g, unknown or other
  modified_base (990)..(990): a, c, t, g, unknown or other
  modified_base (994)..(994): a, c, t, g, unknown or other
  modified_base (996)..(996): a, c, t, g, unknown or other
  modified_base (998)..(998): a, c, t, g, unknown or other
  modified_base (1000)..(1004): a, c, t, g, unknown or other
  modified_base (1006)..(1007): a, c, t, g, unknown or other
  modified_base (1009)..(1009): a, c, t, g, unknown or other
  modified_base (1012)..(1019): a, c, t, g, unknown or other
  modified_base (1022)..(1023): a, c, t, g, unknown or other
  modified_base (1026)..(1030): a, c, t, g, unknown or other
  modified_base (1033)..(1034): a, c, t, g, unknown or other
  modified_base (1037)..(1038): a, c, t, g, unknown or other
  modified_base (1043)..(1043): a, c, t, g, unknown or other
  modified_base (1047)..(1049): a, c, t, g, unknown or other
  modified_base (1054)..(1054): a, c, t, g, unknown or other
  modified_base (1057)..(1059): a, c, t, g, unknown or other
  modified_base (1061)..(1062): a, c, t, g, unknown or other
  modified_base (1077)..(1078): a, c, t, g, unknown or other
  modified_base (1080)..(1081): a, c, t, g, unknown or other
  modified_base (1084)..(1084): a, c, t, g, unknown or other
  modified_base (1087)..(1088): a, c, t, g, unknown or other
  modified_base (1091)..(1091): a, c, t, g, unknown or other
  modified_base (1094)..(1094): a, c, t, g, unknown or other
  modified_base (1096)..(1103): a, c, t, g, unknown or other
  modified_base (1107)..(1107): a, c, t, g, unknown or other
  modified_base (1109)..(1110): a, c, t, g, unknown or other
  modified_base (1115)..(1115): a, c, t, g, unknown or other
  modified_base (1117)..(1122): a, c, t, g, unknown or other
nnnnnnnnnnnnnnnnnnnntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcccaggtgcagctggtgcagtctggggctgaggtgaagaagcctgggtcgtcggtgaaggtctcctgcaaggcttctggaggcaccttcagtagctatgctatcaactgggtgcgacaggcccctggacaagggcttgagtggatgggaaggatcatccctatcgttggtatagcaaactacgcacagaagttccagggcagagtcacgattacggcggacaaatcctcgagcacagcctacatggagctgagcagcctgagatctgaggacacggccgtgtattactgtgcgagagatctcctggacccccagctagatgatgcttttgatatctggggccaagggacaatggtcaccgtctcttcagcgtcgaccaagggcccatcggtcttccccctggcaccctcctccaagagcacctctgggggcacagcggccctgggctgcctggtcaaggactacttccccgaacctgtgacggtctcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccnnntggacaagagagttgagcccaaatcttgtgacaaactcacacatgcccaccgtgcccagcacctgaactcctggggggaccgtcagtcttcctctnnccccaaacccaangacnccctcatgatcncccnganccctgangncncntgcgtgnnggnggangngngnnnnnannanccnnnnnnnnccnngannnnnaanntcnnctggntacnnnggacngcnnngnnggtgcataatgccannannaanccnnggnagnannnnnnnnaacngnncgttncnnnnnn

SEQ ID NO: 3653 - DNA, 367 bp, Artificial Sequence; identical to SEQ ID NO: 349
  source: /note="Description of Artificial Sequence: Synthetic polynucleotide"

SEQ ID NO: 3654 - DNA, 1115 bp, Artificial Sequence
  source: /note="Description of Artificial Sequence: Synthetic polynucleotide"
  modified_base (1)..(6): a, c, t, g, unknown or other
  modified_base (8)..(10): a, c, t, g, unknown or other
  modified_base (14)..(14): a, c, t, g, unknown or other
  modified_base (17)..(18): a, c, t, g, unknown or other
  modified_base (22)..(22): a, c, t, g, unknown or other
  modified_base (943)..(943): a, c, t, g, unknown or other
  modified_base (954)..(954): a, c, t, g, unknown or other
  modified_base (990)..(990): a, c, t, g, unknown or other
  modified_base (993)..(993): a, c, t, g, unknown or other
  modified_base (1002)..(1002): a, c, t, g, unknown or other
  modified_base (1008)..(1008): a, c, t, g, unknown or other
  modified_base (1016)..(1017): a, c, t, g, unknown or other
  modified_base (1025)..(1025): a, c, t, g, unknown or other
  modified_base (1036)..(1036): a, c, t, g, unknown or other
  modified_base (1043)..(1043): a, c, t, g, unknown or other
  modified_base (1046)..(1048): a, c, t, g, unknown or other
  modified_base (1056)..(1057): a, c, t, g, unknown or other
  modified_base (1068)..(1068): a, c, t, g, unknown or other
  modified_base (1070)..(1073): a, c, t, g, unknown or other
  modified_base (1078)..(1081): a, c, t, g, unknown or other
  modified_base (1085)..(1085): a, c, t, g, unknown or other
  modified_base (1087)..(1088): a, c, t, g, unknown or other
  modified_base (1097)..(1099): a, c, t, g, unknown or other
  modified_base (1104)..(1106): a, c, t, g, unknown or other
  modified_base (1108)..(1108): a, c, t, g, unknown or other
  modified_base (1111)..(1111): a, c, t, g, unknown or other
  modified_base (1113)..(1115): a, c, t, g, unknown or other
nnnnnncnnnatgnatnntacncatacgatttaggtgacactatagaataacatccactttgcctttctctccacaggtgtccactcccaggtccaactgcacctcggttctatcgattgaattccaccatgggatggtcatgtatcatcctttttctagtagcaactgcaaccggtgtacattcagaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagaagcttggccgccatggcccaacttgtttattgcagcttataatggttacaaataaagcaatagcatcacaaatttcacaaataaagcatttttttcactgcattctanttgtggtttgnccaaactcatcaatgtatcttatcatgtctggatcnggnattaattcngcgcancaccatgnnctgaaatnacctctgaaanaggaacntgnnnaaggtacnntctgaagccgnannnncatcnnnngaangnnggtcaaatnnnggggnnngnaangnnn

SEQ ID NO: 3655 - DNA, 325 bp, Artificial Sequence; identical to SEQ ID NO: 350
  source: /note="Description of Artificial Sequence: Synthetic polynucleotide"

SEQ ID NO: 3656 - protein, 9 aa, Artificial Sequence
  source: /note="Description of Artificial Sequence: Synthetic peptide"
MQGTHWPPT

What is claimed is:

1. A recombinantly produced anti-SARS-CoV-2 antibody or antigen-binding fragment thereof that binds specifically to a SARS-CoV-2 antigen comprising a Spike (S) polypeptide of a human or an animal SARS-CoV-2, comprising a heavy chain variable region (HCVR) having the amino acid sequence of SEQ ID NO: 2900 and a light chain variable region (LCVR) having the amino acid sequence of SEQ ID NO: 2912.

2. The antibody or antigen-binding fragment thereof of claim 1, wherein the antibody or antigen-binding fragment thereof is capable of neutralizing a plurality of SARS-CoV-2 strains.

3. A recombinantly produced anti-SARS-CoV-2 antibody or antigen-binding fragment thereof that binds specifically to a SARS-CoV-2 antigen comprising a Spike (S) polypeptide of a human or an animal SARS-CoV-2, comprising a heavy chain/light chain sequence pair of SEQ ID NOs: 2886/2898, 2886/2899, 2887/2898, 2887/2899, 2910/2921, 2910/2922, 2911/2921, or 2911/2922.

4. The antibody or antigen-binding fragment thereof of claim 1, wherein the antibody or antigen-binding fragment thereof is a multivalent antibody comprising (a) a first target binding site that specifically binds to an epitope within the Spike (S) polypeptide, and (b) a second target binding site that binds to an epitope on a different epitope on the Spike (S) polypeptide or a different molecule.

5. The antibody or antigen-binding fragment thereof of claim 4, wherein the multivalent antibody is a bivalent or bispecific antibody.

6. The antibody or the antigen-binding fragment thereof of claim 1, further comprising a variant Fc constant region.

7. The antibody or the antigen-binding fragment thereof of claim 1, wherein the variant Fc constant region comprises M428L and N434S substitutions according to the EU numbering.

8. The antibody or the antigen-binding fragment thereof of claim 1, wherein the antibody is a chimeric antibody, a humanized antibody, or humanized monoclonal antibody.

9. A pharmaceutical composition comprising the antibody or antigen-binding fragment thereof of claim 1 and a pharmaceutically acceptable carrier or excipient.

10. The pharmaceutical composition of claim 9, further comprising a second therapeutic agent.

11. A kit comprising a pharmaceutically acceptable dose unit of the antibody or antigen-binding fragment thereof of claim 1.

12. A kit for the diagnosis, prognosis or monitoring treatment of SARS-CoV-2 in a subject, comprising: the antibody or antigen-binding fragment thereof of claim 1; and a least one detection reagent that binds specifically to the antibody or antigen-binding fragment thereof.

* * * * *